United States Patent
Barouch et al.

(10) Patent No.: US 11,773,142 B2
(45) Date of Patent: Oct. 3, 2023

(54) RECOMBINANT ADENOVIRUSES AND USES THEREOF

(71) Applicant: Beth Israel Deaconess Medical Center, Inc., Boston, MA (US)

(72) Inventors: Dan H. Barouch, Newton, MA (US); Peter Abbink, Winthrop, MA (US); Mark Justin Iampietro, Boston, MA (US); Menzo J. E. Havenga, Boston, MA (US)

(73) Assignee: Beth Israel Deaconess Medical Center, Inc., Boston, MA (US)

( * ) Notice: Subject to any disclaimer, the term of this patent is extended or adjusted under 35 U.S.C. 154(b) by 445 days.

(21) Appl. No.: 16/772,045

(22) PCT Filed: Dec. 11, 2018

(86) PCT No.: PCT/US2018/064978
§ 371 (c)(1),
(2) Date: Jun. 11, 2020

(87) PCT Pub. No.: WO2019/118480
PCT Pub. Date: Jun. 20, 2019

(65) Prior Publication Data
US 2020/0399323 A1 Dec. 24, 2020

Related U.S. Application Data

(60) Provisional application No. 62/641,774, filed on Mar. 12, 2018, provisional application No. 62/607,288, filed on Dec. 18, 2017, provisional application No. 62/597,268, filed on Dec. 11, 2017.

(51) Int. Cl.
| | |
|---|---|
| C07K 14/075 | (2006.01) |
| A61K 35/761 | (2015.01) |
| A61K 39/235 | (2006.01) |
| A61K 31/7088 | (2006.01) |
| C07K 14/54 | (2006.01) |
| C12N 15/861 | (2006.01) |

(52) U.S. Cl.
CPC ........ *C07K 14/075* (2013.01); *A61K 31/7088* (2013.01); *A61K 35/761* (2013.01); *A61K 39/235* (2013.01); *C07K 14/5425* (2013.01); *C12N 15/861* (2013.01)

(58) Field of Classification Search
None
See application file for complete search history.

(56) References Cited

U.S. PATENT DOCUMENTS

| | | | |
|---|---|---|---|
| 4,695,623 | A | 9/1987 | Stabinsky |
| 7,247,472 | B2 | 7/2007 | Wilson et al. |
| 9,718,863 | B2 | 8/2017 | Colloca et al. |
| 10,106,781 | B2 | 10/2018 | Barouch et al. |
| 2004/0136963 | A1 | 7/2004 | Wilson et al. |
| 2005/0232900 | A1 | 10/2005 | Vogels et al. |
| 2010/0034774 | A1 | 2/2010 | Vogels et al. |
| 2011/0000480 | A1 | 1/2011 | Turner et al. |
| 2011/0306090 | A1 | 12/2011 | Francky et al. |
| 2012/0027788 | A1 | 2/2012 | Colloca et al. |
| 2012/0076812 | A1 | 3/2012 | Barouch et al. |
| 2014/0348791 | A1 | 11/2014 | Barouch et al. |
| 2015/0291935 | A1 | 10/2015 | Barouch et al. |
| 2017/0119872 | A1 | 5/2017 | O'Hagan et al. |
| 2019/0136205 | A1 | 5/2019 | Barouch et al. |

FOREIGN PATENT DOCUMENTS

| | | |
|---|---|---|
| EP | 1944043 A1 | 7/2008 |
| WO | WO-97/00326 A1 | 1/1997 |
| WO | WO-00/70071 A1 | 11/2000 |
| WO | WO-01/02607 A1 | 1/2001 |
| WO | WO-02/22080 A2 | 3/2002 |
| WO | WO-02/40665 A2 | 5/2002 |
| WO | WO-2003046124 A2 | 6/2003 |
| WO | WO-2007/104792 A2 | 9/2007 |
| WO | WO-2008/010864 A2 | 1/2008 |
| WO | WO-2011/057248 A2 | 5/2011 |
| WO | WO-2011/057254 A2 | 5/2011 |
| WO | WO-2011/129468 A1 | 10/2011 |
| WO | WO-2012/021730 A2 | 2/2012 |
| WO | WO-2012/024351 A2 | 2/2012 |
| WO | WO-2014/078688 A2 | 5/2014 |

OTHER PUBLICATIONS

Wu et al. Flexibility of the Adenovirus Fiber Is Required for Efficient Receptor Interaction. Journal of Virology, Jul. 2003, p. 7225-7235, vol. 77, No. 13.*
Morris et al. Simian adenoviruses as vaccine vectors. Future Virol. (2016) 11(9), 649-659.*
GenBank: KP329562.1. Simian adenovirus 11 strain P-10, complete genome. Dated Jan. 29, 2016.*
Awasthi et al. Genital Herpes by Using Glycoprotein C and D Subunit Antigens to Induce Potent Antibody Responses and Adenovirus Vectors Containing Capsid and Tegument Proteins as T Cell Immunogens. J. Virol, 2015, 89:8497-8509.*
Communication Pursuant to 164(1) EPC for European Patent Application No. 18889863.9, dated Nov. 3, 2021 (22 pages).

(Continued)

*Primary Examiner* — Nianxiang Zou
(74) *Attorney, Agent, or Firm* — Clark & Elbing LLP

(57) ABSTRACT

Featured are recombinant adenoviruses and vectors thereof. In particular, the adenoviruses are simian (rhesus) adenoviruses having a low seroprevalence and high immunogenicity (when expressing, e.g., an antigenic polypeptide) relative to other adenoviruses and vectors thereof. Also featured are methods for producing the adenoviruses and methods of treatment of diseases by administering the adenoviral vector(s) to a subject (e.g., a human).

26 Claims, 113 Drawing Sheets

Specification includes a Sequence Listing.

(56) References Cited

OTHER PUBLICATIONS

GenBank Accession No. KM591901.1, "Rhesus adenovirus 51, complete genome," retrieved from <https://www.ncbi.nlm.nih.gov/nuccore/KM591901.1>, dated Apr. 21, 2015 (11 pages).
GenBank Accession No. KM591902.1, "Rhesus adenovirus 52, complete genome," retrieved from <https://www.ncbi.nlm.nih.gov/nuccore/KM591902>, dated Apr. 21, 2015 (11 pages).
GenBank Accession No. KM591903.1, "Rhesus adenovirus 53, complete genome," retrieved from <https://www.ncbi.nlm.nih.gov/nuccore/KM591903>, dated Apr. 21, 2015 (11 pages).
"UniProtKB-Q5C8P9," UniProtKB, retrieved from <https://www.uniprot.org/uniprot/Q5C8P9> (2005) (7 pages).
"UniProt: A0A0M5L3Y8," UniProt (2015) (2 pages).
Extended European Search Report for European Patent Application No. 18889863.9, dated Mar. 10, 2022 (24 pages).
Pantó et al., "Taxonomy Proposal for Old World Monkey Adenoviruses: Characterisation of Several Non-Human, Non-Ape Primate Adenovirus Lineages," Arch Virol. 160: 3165-77 (2015) (14 pages).
"Sequence alignment results, EMBOSS Needle/Pairwise Sequence Alignment/EMBLE-EBI web site," <www.ebi.ac.uk/Tools/psa/emboss_needle/nucleotide.html>, retrieved on Feb. 15, 2019 (10 pages).
Abbink et al., "Comparative seroprevalence and immunogenicity of six rare serotype recombinant adenovirus vaccine vectors from subgroups B and D," J Virol. 81(9):4654-63 (2007).
Abbink et al., "Construction and Evaluation of Novel Rhesus Monkey Adenovirus Vaccine Vectors," J Virol. 89(3):1512-22 (2015) (11 pages).
Abbink et al., "Development of Novel Simian Adenovirus Based Vaccine Vectors." Poster, 2013. <epostersonline.s3.amazonaws.com>. Retrieved on Apr. 16, 2014 (1 page).
Abbink et al. "Rapid Cloning of Novel Rhesus Adenoviral Vaccine Vectors," J Virol. 92(6):e01924-17 (2018) (11 pages).
Bangari et al. "Development of nonhuman adenoviruses as vaccine vectors," Vaccine 24(7):849-62 (2006) (21 pages).
Barouch et al. "Immunogenicity of recombinant adenovirus serotype 35 vaccine in the presence of pre-existing anti-Ad5 immunity," J Immunol. 172(10):6290-7 (2004) (9 pages).
Barouch et al. "International seroepidemiology of adenovirus serotypes 5, 26, 35, and 48 in pediatric and adult populations," Vaccine. 29(32):5203-9 (2011) (14 pages).
Communication Pursuant to 94(3) EPC for European Patent Application No. 13854932.4, dated Sep. 28, 2017 (8 pages).
Communication pursuant to Article 94(3) EPC for European Application No. 1979450.2, dated May 13, 2020 (5 pages).
Communication Pursuant to Rules 70(2) and 70a(2) EPC for European Patent Application No. 13854932.4, dated Jul. 5, 2016 (6 pages).
Dicks et al. "A novel chimpanzee adenovirus vector with low human seroprevalence: improved systems for vector derivation and comparative immunogenicity," PLoS One 7(7):e40385 (2012) (12 pages).
EMBOSS Needle, "Pairwise Sequence Alignment (Nucleotide)," www.ebi.ac.uk/Tools/psa/emboss_needle/nucleotide.html, retrieved Feb. 28, 2019 (10 pages).
EMBOSS Needle, "Pairwise Sequence Alignment (Protein)," www.ebi.ac.uk/Tools/psa/emboss_needle/, retrieved Aug. 18, 2017 (40 pages).
Examination Report for Australian Patent Application No. 2018229561, dated Jun. 21, 2019 (4 pages).
Examination Review Report for Singaporean Patent Application No. 11201503864T, dated Apr. 22, 2019 (4 pages).
Extended European Search Report for European Patent Application No. 13854932.4, dated Jun. 17, 2016 (8 pages).
Extended European Search Report for European Patent Application No. 19179450.2, dated Oct. 9, 2019 (7 pages).
Finkbeiner, et al., "Metagenomic analysis of human diarrhea: viral detection and discovery," PLoS Pathog. 4(2):e1000011 (2008) (9 pages).
First Examination Report for New Zealand Patent Application No. 708144, dated Mar. 13, 2019 (5 pages).
Foy et al. "Probable Non-Vector-borne Transmission of Zika Virus, Colorado, USA," Emerg Infect Dis. 17(5):880-2 (2011) (7 pages).
Geisbert et al. "Recombinant adenovirus serotype 26 (Ad26) and Ad35 vaccine vectors bypass immunity to Ad5 and protect nonhuman primates against ebolavirus challenge," J Virol. 85(9):4222-33 (2011).
GenBank Accession No. AF326321.1. Retrieved on Apr. 16, 2014 (3 pages).
GenBank Accession No. AY771780. Retrieved Oct. 24, 2017 (17 pages).
GenBank Accession No. AY771780.1. Retrieved on Apr. 16, 2014 (15 pages).
GenBank Accession No. AZ111781.1. Retrieved on Jul. 13, 2016 (2 pages).
GenBank Accession No. AZI11781.1. Retrieved Jan. 7, 2020 (2 Pages).
GenBank Accession No. JA453575.1. Retrieved on Jul. 13, 2016 (8 pages).
Handley et al., "Pathogenic simian immunodeficiency virus infection is associated with expansion of the enteric virome," Cell. 151(2):253-66 (2012).
Hayes, "Zika virus outside Africa," Emerg Infect Dis. 15(9):1347-50 (2009).
Holterman et al., "Novel replication-incompetent vector derived from adenovirus type 11 (Ad11) for vaccination and gene therapy: low seroprevalence and non-cross-reactivity with Ad5," J Virol. 78(23):13207-15 (2004).
International Preliminary Report on Patentability for International Application No. PCT/US2018/064978, dated Jun. 16, 2020 (9 pages).
International Preliminary Report on Patentability for International Patent Application No. PCT/US2013/070353, dated May 19, 2015 (8 pages).
International Search Report and Written Opinion for International Application No. PCT/US2018/064978 dated Apr. 24, 2019 (20 pages).
International Search Report and Written Opinion for International Patent Application No. PCT/US13/70353, dated May 12, 2014 (17 pages).
Kass-Eisler et al., "Circumventing the immune response to adenovirus-mediated gene therapy," Gene Ther. 3(2):154-62 (1996) (10 pages).
Kass-Eisler et al., "The Impact of Developmental Stage, Route of Administration and the Immune System on Adenovirus-Mediated Gene Transfer," Gene Ther. 1(6):395-402 (1994).
Kovacs et al., "Complete genome sequence of simian adenovirus 1: an Old World monkey adenovirus with two fiber genes," Journal of General Virology. 86(6): 1681-6 (2005).
Kubo, "The Task of Isolating and Identifying Human Pathogenic Viruses," Seikatsu Eisei. 50(5):381-6 (2006) (English language abstract included).
Kuno et al., "Full-length sequencing and genomic characterization of Bagaza, Kedougou, and Zika viruses," Arch Virol. 152(4):687-96 (2007).
Larocca et al., "Vaccine protection against Zika virus from Brazil," Nature. 536(7617):474-8 (2016) (15 pages).
Lemckert et al., "Immunogenicity of heterologous prime-boost regimens involving recombinant adenovirus serotype 11 (Ad11) and Ad35 vaccine vectors in the presence of anti-ad5 immunity," J Virol. 79(15):9694-701 (2005).
Letvin et al., "Prospects for vaccine protection against HIV-1 infection and AIDS," Annu Rev Immunol. 20:73-99 (2002).
Liu et al., "Modulation of DNA vaccine-elicited CD8$^+$ T-lymphocyte epitope immunodominance hierarchies," J Virol. 80(24):11991-7 (2006).
Notice of Reasons for Rejection for Japanese Patent Application No. 2015-542833, dated Sep. 5, 2017 (20 pages).
Office Action for Chinese Patent Application No. 201380068078.0, dated Apr. 4, 2018 (5 pages).
Office Action for Israeli Patent Application No. 238847, dated May 27, 2019 (5 pages).

(56) References Cited

OTHER PUBLICATIONS

Office Action for Japanese Patent Application No. 2015-542833, dated Apr. 22, 2020 (4 pages).
Office Action for Japanese Patent Application No. 2015-542833, dated Aug. 7, 2018 (8 pages).
Office Action for Japanese Patent Application No. 2018-038380, dated Mar. 10, 2020 (16 pages).
Office Action for Japanese Patent Application No. 2018-038380, dated Mar. 12, 2019 (28 pages).
Ostapchuk et al., "Pseudopackaging of adenovirus type 5 genomes into capsids containing the hexon proteins of adenovirus serotypes B, D, or E," J Virol. 75(1):45-51 (2001).
Poland et al., "Development of vaccines against Zika virus," Lancet Infect Dis. 18(7):e211-e219 (2018) (9 pages).
Search Report for Singaporean Application No. 11201503864T, dated Feb. 29, 2016 (3 pages).
Setoguchi et al., "Intraperitoneal In Vivo Gene Therapy to Deliver alpha1-Antitrypsin to the Systemic Circulation," Am J Respir Cell Mol Biol. 10(4):369-77 (1994).
Shiver et al., "Recent advances in the development of HIV-1 vaccines using replication-incompetent adenovirus vectors," Annu Rev Med. 55:355-72 (2004).
Shiver et al., "Replication-incompetent adenoviral vaccine vector elicits effective anti-immunodeficiency-virus immunity," Nature. 415(6869):331-5 (2002).
Sprangers et al., "Quantifying adenovirus-neutralizing antibodies by luciferase transgene detection: addressing preexisting immunity to vaccine and gene therapy vectors," J Clin Microbiol. 41(11):5046-52 (2003).
Sumida et al., "Neutralizing antibodies to adenovirus serotype 5 vaccine vectors are directed primarily against the adenovirus hexon protein," J Immunol. 174(11):7179-85 (2005).
Tripp et al., "Development of a Zika vaccine," Expert Rev Vaccines. 15(9):1083-5 (2016).
Vogels et al., "Replication-deficient human adenovirus type 35 vectors for gene transfer and vaccination: efficient human cell infection and bypass of preexisting adenovirus immunity," J Virol. 77(15):8263-71 (2003).
Wodrich et al., "Switch from capsid protein import to adenovirus assembly by cleavage of nuclear transport signals," EMBO J. 22(23):6245-55 (2003).
Written Opinion for Singaporean Application No. 11201503864T, dated Apr. 1, 2016 (6 pages).
Yei et al., "Adenovirus-mediated Gene Transfer for Cystic Fibrosis: Quantitative Evaluation of Repeated in Vivo Vector Administration to the Lung," Gene Ther. 1(3):192-200 (1994).
Zabner et al., "Safety and efficacy of repetitive adenovirus-mediated transfer of CFTR cDNA to airway epithelia of primates and cotton rats," Nat Genet. 6(1):75-83 (1994).

\* cited by examiner

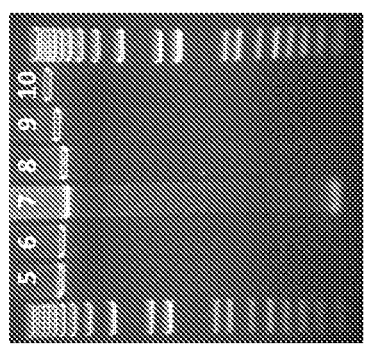
FIG. 2B AdApter
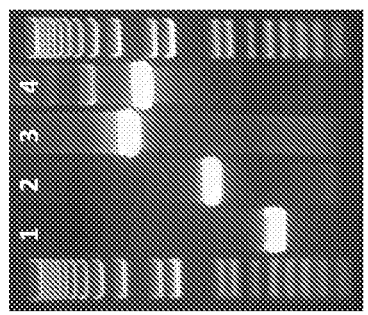
FIG. 2C Cosmid
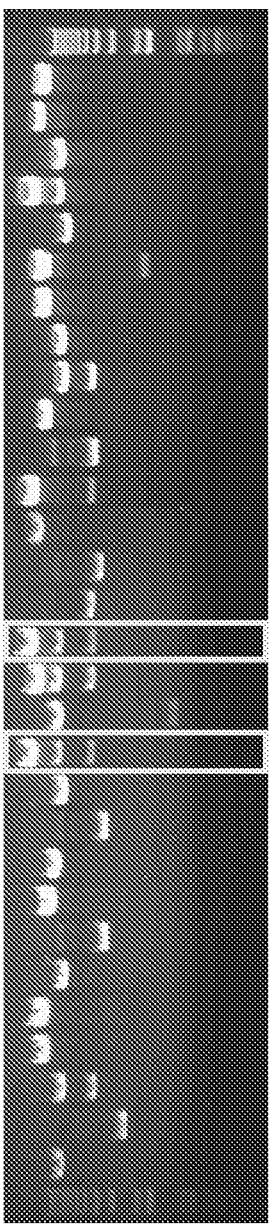
FIG. 2D

FIG. 43 pWe/RhAd66.v2.pIX-rITR.dE3.5orf6

Sequence alignment figure showing multiple sequence alignment of RhAd56, RhAd57, RhAd58, RhAd59, RhAd62, and RhAd66 long fiber sequences (SEQ ID NOs: 146, 147, 148, 149, 152, 156) with consensus sequences. The alignment spans residues approximately 250-560, organized in four blocks:

- Block 1 (residues ~250-320): Consensus begins "VQXNSLSLXFXPPLRLFMSEPVLGLGFTFPITVXDNLLSLNTGDGLTXXYNKLTXNLGRDLQFEMGAIAVXLTXKPPLQY"
- Block 2 (residues ~330-400): Consensus begins "TTXLQLNVGAGLRYNGASXKKLDVDINQWKGLTWENNAXXXXKLGXGLQFDPXGNIAXSPXTVKPDTLWTTADPSPKCSXYT"
- Block 3 (residues ~410-480): Consensus begins "DLDAKLWLSLVKSGGWVHGSIALQALKGTLLSPTDSXITITILXFDXMGVR-XNYPTXDNXGTLXXDATWGYRQGQSAXTN"
- Block 4 (residues ~490-560): Consensus begins "VTNALEFMPSSKRYPRGXGEQAQWQTXGYTCLQGNXSMPIPFXVQYMVXTGYSFKFTWQVVKRQKFDIPCCSFSYITEE"

Sequence position numbers at right end of rows:
- Block 1: all sequences end at 320
- Block 2: 400, 396, 400, 396, 400, 400
- Block 3: 480, 475, 480, 475, 479, 479
- Block 4: 560, 555, 559, 555, 559, 559

| | Consensus | TN-YQDVKLPYQHNSGFVGYMGPTMREGQAYPANYPYPLIGATAVPSLTQKKFLCDRVMWRIPFSSNFMSMGSLTDLGQ | |
|---|---|---|---|
| | | 810    820    830    840    850    860    870    880 | |
| RhAd54 hexon SEQ ID NO: 158 | | TN-YQDVKLPYQHNSGFVGYMGPTMREGQAYPANYPYPLIGATAVPSLTQKKFLCDRVMWRIPFSSNFMSMGSLTDLGQ | 869 |
| RhAd55 hexon SEQ ID NO: 159 | | TN-YQDVKLPYQHNSGFVGYMGPTMREGQAYPANYPYPLIGATAVPSLTQKKFLCDRVMWRIPFSSNFMSMGSLTDLGQ | 870 |
| RhAd56 hexon SEQ ID NO: 160 | | AN-YKEVKMPFQHNSGFVGYMGPTMREGQAYPANYPYPLIGATAVPSLTQKKFLCDRVMWRIPFSSNFMSMGSLTDLGQ | 869 |
| RhAd57 hexon SEQ ID NO: 161 | | TN-YQDVKLPYQHNSGFVGYMGPTMREGQAYPANYPYPLIGATAVPSLTQKKFLCDRVMWRIPFSSNFMSMGSLTDLGQ | 856 |
| RhAd58 hexon SEQ ID NO: 162 | | TD-YKDVKLPYQHNSGFVGYMGPTMREGQAYPANYPYPLIGETAVPSLTQKKFLCDRVMWRIPFSSNFMSMGSLTDLGQ | 856 |
| RhAd59 hexon SEQ ID NO: 163 | | TD-YKDVKLPYQHNSGFVGYMGPTMREGQAYPANYPYPLIGETAVPSLTQKKFLCDRVMWRIPFSSNFMSMGALTDLGQ | 857 |
| RhAd60 hexon SEQ ID NO: 164 | | TN-YQDVKLPYQHNSGFVGYMGPTMREGQAYPANYPYPLIGATAVPSLTQKKFLCDRVMWRIPFSSNFMSMGSLTDLGQ | 859 |
| RhAd61 hexon SEQ ID NO: 165 | | TD-YKDVKLPYQHNSGFVGYMGPTMREGQAYPANYPYPLIGATAVPSLTQKKFLCDRVMWRIPFSSNFMSMGSLTDLGQ | 875 |
| RhAd62 hexon SEQ ID NO: 166 | | TN-YQDVKLPYQHNSGFVGYMGPTMREGQAYPANYPYPLIGATAVPSLTQKKFLCDRVMWRIPFSSNFMSMGSLTDLGQ | 857 |
| RhAd63 hexon SEQ ID NO: 167 | | TD-YKDVKLPYQHNSGFVGYMGPTMREGQAYPANYPYPLIGATAVPSLTQKKFLCDRVMWRIPFSSNFMSMGSLTDLGQ | 869 |
| RhAd64 hexon SEQ ID NO: 168 | | AN-YKEVKMPFQHNSGFVGYMGPTMREGQAYPANYFYPLIGATAVPSLTQKKFLCDRVMWRIPFSSNFMSMGSLTDLGQ | 873 |
| RhAd65 hexon SEQ ID NO: 169 | | KDYYQDVKLPYQHNSGFVGYMGPTMREGQAYPANYPYPLIGATAVPSLTQKKFLCDRVMWRIPFSSNFMSMGSLTDLGQ | 869 |
| RhAd66 hexon SEQ ID NO: 170 | | AN-YKEVKMPFQHNSGFVGYMGPTMREGQAYPANYPYPLIGATAVPSLTQKKFLCDRVMWRIPFSSNFMSMGSLTDLGQ | 869 |
| RhAd67 hexon SEQ ID NO: 171 | | KDYYQDVKLPYQHNSGFVGYMGPTMREGQAYPANYPYPLIGATAVPSLTQKKFLCDRVMWRIPFSSNFMSMGSLTDLGQ | 873 |

| | Consensus | MMLYANSAHALDMTFEVDPMDEPTLLYVLFEVFDVVRIHQPHRGVIEAVYLRTPFSAGNATT | |
|---|---|---|---|
| | | 890    900    910    920    930    940 | |
| RhAd54 hexon SEQ ID NO: 158 | | MMLYANSAHALDMTFEVDPMDEPTLLYVLFEVFDVVRIHQPHRGVIEAVYLRTPFSAGNATT | 931 |
| RhAd55 hexon SEQ ID NO: 159 | | MMLYANSAHALDMTFEVDPMDEPTLLYVLFEVFDVVRIHQPHRGVIEAVYLRTPFSAGNATT | 932 |
| RhAd56 hexon SEQ ID NO: 160 | | MMLYANSAHALDMTFEVDPMDEPTLLYVLFEVFDVVRIHQPHRGVIEAVYLRTPFSAGNATT | 931 |
| RhAd57 hexon SEQ ID NO: 161 | | MMLYANSAHALDMTFEVDPMDEPTLLYVLFEVFDVVRIHQPHRGVIEAVYLRTPFSAGNATT | 918 |
| RhAd58 hexon SEQ ID NO: 162 | | MMLYANSAHALDMTFELDPMDEPTLLYVLFEVFDVVRIHQPHRGVIEAVYLRTPFSAGNATT | 918 |
| RhAd59 hexon SEQ ID NO: 163 | | MMLYANSAHALDMTFEVDPMDEPTLLYVLFEVFDVVRIHQPHRGVIEAVYLRTPFSAGNATT | 919 |
| RhAd60 hexon SEQ ID NO: 164 | | MMLYANSAHALDMTFEVDPMDEPTLLYVLFEVFDVVRIHQPHRGVIEAVYLRTPFSAGNATT | 921 |
| RhAd61 hexon SEQ ID NO: 165 | | MMLYANSAHALDMTFEVDPMDEPTLLYVLFEVFDVVRIHQPHRGVIEAVYLRTPFSAGNATT | 937 |
| RhAd62 hexon SEQ ID NO: 166 | | MMLYANSAHALDMTFEVDPMDEPTLLYVLFEVFDVVRIHQPHRGVIEAVYLRTPFSAGNATT | 919 |
| RhAd63 hexon SEQ ID NO: 167 | | MMLYANSAHALDMTFEVDPMDEPTLLYVLFEVFDVVRIHQPHRGVIEAVYLRTPFSAGNATT | 931 |
| RhAd64 hexon SEQ ID NO: 168 | | MMLYANSAHALDMTFEVDPMDEPTLLYVLFEVFDVVRIHQPHRGVIEAVYLRTPFSAGNATT | 935 |
| RhAd65 hexon SEQ ID NO: 169 | | MMLYANSAHALDMTFEVDPMDEPTLLYVLFEVFDVVRIHQPHRGVIEAVYLRTPFSAGNATT | 931 |
| RhAd66 hexon SEQ ID NO: 170 | | MMLYANSAHALDMTFEVDPMDEPTLLYVLFEVFDVVRIHQPHRGVIEAVYLRTPFSAGNATT | 931 |
| RhAd67 hexon SEQ ID NO: 171 | | MMLYANSAHALDMTFEVDPMDEPTLLYVLFEVFDVVRIHQPHRGVIEAVYLRTPFSAGNATT | 935 |

FIG. 54B

RECOMBINANT ADENOVIRUSES AND USES THEREOF

STATEMENT AS TO FEDERALLY FUNDED RESEARCH

This invention was made with government support under Grant Nos. A1078526 and A1096040, awarded by the National Institutes of Health (NIH). The government has certain rights in the invention.

BACKGROUND OF THE INVENTION

Recombinant adenoviral vectors have been used in the development of vaccines. To date, approximately 55 different adenovirus serotypes have been identified. The subgroup C adenoviruses have been most extensively studied for applications such as vaccination and gene therapy. Adenovirus serotypes 2 and 5 (Ad2 and Ad5), in particular, are widely used in the field. Importantly, Ad5 vector-based vaccines have been shown to elicit potent and protective immune responses in a variety of animal models. Moreover, large-scale clinical trials for HIV vaccination using Ad5-based recombinant vectors are ongoing (see, e.g., WO 01/02607; WO 02/22080; Shiver et al., *Nature.* 415:331-335, 2002; Letvin et al., *Annu. Rev. Immunol.* 20:73-99, 2002; and Shiver and Emini, *Annu. Rev. Med.* 55:355, 2004).

The usefulness of recombinant Ad5 vector-based vaccines for HIV and other pathogens, however, may be limited due to high pre-existing anti-Ad5 immunity in human populations. The presence of anti-Ad5 immunity has been correlated with a reduction in the immunogenicity of Ad5-based vaccines in studies in mice and rhesus monkeys. Early data from phase-1 clinical trials show that this problem may also occur in humans. Although both Ad5-specific neutralizing antibodies (NAbs) and $CD8^+$ T lymphocytes contribute to anti-Ad5 immunity, the Ad5-specific NAbs appear to play the primary role in this process (Sumida et al., *J. Virol.,* 174:7179-7185, 2004).

Accordingly, there is an unmet need for alternative adenoviral vectors that have low seroprevalence and potent immunogenicity.

SUMMARY OF THE INVENTION

Disclosed herein are simian adenoviruses and compositions, methods of treatment, and methods of making the same. In particular, fourteen simian (rhesus) adenoviruses (RhAd), RhAd54 (RhAd4282), RhAd55 (RhAd4300), RhAd56 (RhAd4302), RhAd57 (RhAd4305), RhAd58 (RhAd4308), RhAd59 (RhAd4309), RhAd60 (RhAd4310B), RhAd61 (RhAd6665), RhAd62 (RhAd6666), RhAd63 (RhAd6668A), RhAd64 (RhAd6668B), RhAd65 (RhAd6669), RhAd66 (RhAd6672), and RhAd67 (RhAd6673) (i.e., RhAd54-RhAd67), have been identified and their entire genomes determined. These adenoviruses exhibit both surprisingly low seroprevalence and potent immunogenicity, e.g., when used to deliver an immunogenic agent, such as an antigenic polypeptide. Thus, these RhAds are useful as vaccine vectors.

In a first aspect, featured is an isolated polynucleotide or complement thereof comprising a nucleotide sequence encoding three adenoviral fiber proteins.

In some embodiments, at least one, at least two, or all three of the adenoviral fiber proteins includes an amino acid sequence having at least 85% (e.g., 90%, 92%, 95%, 97%, 98%, 99%, or 100% sequence identity) sequence identity to all or a part of the amino acid sequence of any one of SEQ ID NOs: 121, 122, 124, 125, 127-132, 134-143, 145, 147, 149-151, and 153-157.

In some embodiments, each of the fiber proteins includes a different amino acid sequence. In some embodiments, two or three of the fiber proteins include the same amino acid sequence.

In some embodiments, the three fiber proteins encoded by the polynucleotide: (i) have the amino acid sequences of SEQ ID NOs: 121, 122, and 145, respectively; (ii) have the amino acid sequences of SEQ ID NOs: 124, 125, and 147, respectively; (iii) have the amino acid sequences of SEQ ID NOs: 127, 128, and 149, respectively; (iv) have the amino acid sequences of SEQ ID NOs: 129, 130, and 150, respectively; (v) have the amino acid sequences of SEQ ID NOs: 131, 132, and 151, respectively; (vi) have the amino acid sequences of SEQ ID NOs: 134, 135, and 153, respectively; (vii) have the amino acid sequences of SEQ ID NOs: 136, 137, and 154, respectively; (viii) have the amino acid sequences of SEQ ID NOs: 138, 139, and 155, respectively; (ix) have the amino acid sequences of SEQ ID NOs: 140, 141, and 156, respectively; or (x) have the amino acid sequences of SEQ ID NOs: 142, 143, and 157, respectively.

In some embodiments, the nucleotide sequence further encodes a hexon protein including an amino acid sequence having at least 85%, 90%, 92%, 95%, 97%, 98%, 99%, or 100% sequence identity to all or a part of the amino acid sequence of any one of SEQ ID NOs: 159, 161, 163-165, and 167-171.

In some embodiments, the nucleotide sequence further encodes a penton protein including an amino acid sequence having at least 85%, 90%, 92%, 95%, 97%, 98%, 99%, or 100% sequence identity to all or a part of the amino acid sequence of any one of SEQ ID NOs: 211, 213, 215-217, and 219-223.

In some embodiments, the nucleotide sequence has at least 90% sequence identity to all or a part of the nucleic acid sequence of any one of SEQ ID NOs: 2, 4, 6-8, and 10-14. In some embodiments, the nucleotide sequence has at least 92%, 95%, 97%, 98%, 99%, or 100% sequence identity to all or a part of the nucleic acid sequence of any one of SEQ ID NOs: 2, 4, 6 8, and 10-14.

In some embodiments, the nucleotide sequence has at least 90%, 92%, 95%, 97%, 98%, 99%, or 100% sequence identity to all or a part of the nucleic acid sequence of any one of SEQ ID NOs: 226, 227, 234, 235, 240-247, and 250-263.

In a second aspect, featured is a nucleotide sequence encoding a hexon protein, wherein the nucleotide sequence encoding the hexon protein has at least 93% (e.g., 94%, 95%, 96%, 97%, 98%, 99%, and 100% sequence identity) sequence identity over the entire sequence of any one of SEQ ID NOs: 55, 58, 59, 61, 62, 64, 65, and 67.

In some embodiments, the hexon protein includes an amino acid sequence having at least 85%, 90%, 92%, 95%, 97%, 98%, 99%, or 100% sequence identity to any one of SEQ ID NOs: 159, 162, 163, 165, 166, 168, 169, and 171. In some embodiments, the amino acid sequence of the hexon protein includes one or more amino acid substitutions, deletions, or insertions (e.g., a substitution, deletion, or insertion of 2, 3, 4, 5, 6, 7, 8, 9, 10, 15, 20, 25, or 30 amino acids) between one or more of amino acids 120 to 170, amino acids 220 to 270, or amino acids 380 to 430 of SEQ ID NO: 159, 162, 163, 165, 166, 168, 169, or 171.

In some embodiments, the isolated polynucleotide or complement thereof further includes a nucleotide sequence encoding at least one fiber protein, in which the nucleotide sequence encoding the at least one fiber protein has at least 85%, 90%, 92%, 95%, 97%, 98%, 99%, or 100% sequence identity to all or a part (e.g., 20 or more consecutive amino acids) of the nucleic acid sequence of any one of SEQ ID NOs: 17, 18, 22-24, 27-29, 32-35, 38, 39, 41, 43-45, 47, 48, 50, 51, and 53.

In some embodiments, the isolated polynucleotide or complement thereof further includes a nucleotide sequence encoding at least two fiber proteins, in which each of the fiber proteins is encoded by a nucleotide sequence having at least 85%, 90%, 92%, 95%, 97%, 98%, 99%, or 100% sequence identity to all or a part (e.g., 20 or more consecutive amino acids) of the nucleic acid sequence of any one of SEQ ID NOs: 17, 18, 22-24, 27-29, 32-35, 38, 39, 41, 43-45, 47, 48, 50, 51, and 53.

In some embodiments, the isolated polynucleotide or complement thereof further includes a nucleotide sequence encoding at least three fiber proteins, in which each of the fiber proteins is encoded by a nucleotide sequence having at least 85%, 90%, 92%, 95%, 97%, 98%, 99%, or 100% sequence identity to all or a part (e.g., 20 or more consecutive amino acids) of the sequence of any one of SEQ ID NOs: 17, 18, 22-24, 27-29, 32-35, 38, 39, 41, 43-45, 47, 48, 50, 51, and 53.

In some embodiments, the isolated polynucleotide or complement thereof further includes a nucleotide sequence encoding a penton protein, in which the nucleotide sequence encoding the penton protein has at least 85%, 90%, 92%, 95%, 97%, 98%, 99%, or 100% sequence identity to all or a part (e.g., 20 or more consecutive nucleic acids) of the nucleic acid sequence of any one of SEQ ID NOs: 107, 110, 111, 113, 114, 116, 117, and 119.

In some embodiments, the nucleotide sequence has at least 90% (e.g., 92%, 95%, 97%, 98%, 99%, or 100% sequence identity) sequence identity to all or a part (e.g., 20 or more consecutive nucleic acids) of the nucleic acid sequence of any one of SEQ ID NOs: 2, 5, 6, 8, 9, 11, 12, and 14.

In some embodiments, the nucleotide sequence has at least 85%, 90%, 92%, 95%, 97%, 98%, 99%, or 100% sequence identity to all or a part (e.g., 20 or more consecutive nucleic acids) of the nucleic acid sequence of any one of SEQ ID NOs: 226, 227, 236 243, 246-249, 252-255, and 262-263.

In a third aspect, featured is an isolated polynucleotide or complement thereof including a nucleotide sequence encoding a hexon protein, in which the nucleotide sequence encoding the hexon protein has 99% or greater sequence identity over the entire nucleic acid sequence of SEQ ID NO: 56. In some embodiments, the nucleotide sequence encoding the hexon protein has 100% sequence identity to the entire nucleic acid sequence of SEQ ID NO: 56.

In some embodiments, the isolated polynucleotide or complement thereof further includes a nucleotide sequence encoding at least one fiber protein, in which the nucleotide sequence encoding the fiber protein has at least 85%, 90%, 92%, 95%, 97%, 99%, or 100% sequence identity to all or a part (e.g., 20 or more consecutive nucleic acids) of the nucleic acid sequence of any one of SEQ ID NOs: 19 and 42.

In some embodiments, the isolated polynucleotide or complement thereof further includes a nucleotide sequence encoding at least two fiber proteins, in which each of the fiber proteins is encoded by a nucleotide sequence having at least 85%, 90%, 92%, 95%, 97%, 99%, or 100% sequence identity to all or a part (e.g., 20 or more consecutive nucleic acids) of the nucleic acid sequence of SEQ ID NOs: 19 and 42.

In some embodiments, the isolated polynucleotide or complement thereof further includes a nucleotide sequence encoding a penton protein, in which the nucleotide sequence encoding the penton protein has at least 85%, 90%, 92%, 95%, 97%, 99%, or 100% sequence identity to all or a part (e.g., 20 or more consecutive nucleic acids) of the nucleic acid sequence of SEQ ID NO: 108.

In some embodiments, the nucleotide sequence has at least 98% sequence identity over the entire nucleic acid sequence of SEQ ID NO: 3.

In some embodiments, the nucleotide sequence includes the sequence of SEQ ID NO: 3. In some embodiments, the nucleotide sequence has at least 85%, 90%, 92%, 95%, 97%, 98%, 99%, or 100% sequence identity to all or a part (e.g., 20 or more consecutive nucleic acids) of the nucleic acid sequence of any one of SEQ ID NOs: 228-233.

In another aspect, featured are isolated polynucleotides including a nucleotide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of any one of SEQ ID NOs: 1-14, or its complement. SEQ ID NOs: 1-14 are the full-length genome sequence of RhAd54-RhAd67, respectively. The isolated polynucleotides described herein may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10000, 15000, 20000, 25000, 30000, or 35000 or more contiguous or non-contiguous nucleotides of a reference polynucleotide molecule (e.g., any one of SEQ ID NOs: 1-14). In particular, the isolated polynucleotide includes the entire sequence of one or more of SEQ ID Nos. 1-14 or variants thereof with 90%, 95%, 97%, 98%, 99%, or 100% sequence identity thereto.

In some embodiments, the isolated polynucleotides described herein include a nucleotide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of any one of SEQ ID NOs: 16-67 and 106-119, or its complement. SEQ ID NOs: 16-67 and 106-119 feature the nucleotide sequences encoding the short fiber, long fiber, hexon, and penton proteins, respectively of RhAd54-RhAd67.

Accordingly, in some embodiments, the nucleotide sequence encoding all or a portion of the short fiber protein can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the short fiber protein (e.g., short fiber-1 and/or short fiber-2) of any one of RhAd54-RhAd67, which corresponds to SEQ ID NOs: 16-39, respectively. In some embodiments, the recombinant adenovirus includes a nucleotide sequence encoding one short fiber protein (e.g., short fiber-1 or short fiber-2) of one or more of RhAd54-RhAd67, corresponding to SEQ ID NOs: 16-39, respectively. In some embodiments, the recombinant adenovirus includes a nucleotide sequence encoding two short fiber proteins (e.g., short fiber-1 and short fiber-2) of one or more of RhAd54-RhAd67, corresponding to SEQ ID NOs: 16-39, respectively. In some embodiments, the nucleotide sequence encoding all or a portion of the long fiber protein can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the long fiber protein of any one of RhAd54-RhAd67, which corresponds to SEQ ID NOs: 40-53, respectively.

In some embodiments, the recombinant adenovirus includes a nucleotide sequence encoding three fiber proteins (e.g., a short fiber-1 protein, a short fiber-2 protein, and a long fiber protein), in which each nucleotide sequence corresponds to any one of SEQ ID NOs: 16-39 and 40-53. In some embodiments, the recombinant adenovirus includes a nucleotide sequence encoding three fiber proteins (e.g., a short fiber-1 protein, a short fiber-2 protein, and a long fiber protein), in which each fiber protein includes an amino acid sequence having at least 75% sequence identity (e.g., 85%, 95%, 96%, 97%, 98%, 99%, or 100% sequence identity) to the amino acid sequence of any one of SEQ ID NOs: 120-143 and 144-157. In some embodiments, the recombinant adenovirus includes a nucleotide sequence encoding three fiber proteins (e.g., a short fiber-1 protein, a short fiber-2 protein, and a long fiber protein), in which (i) the first fiber protein includes an amino acid sequence having at least 75% sequence identity (e.g., 85%, 95%, 96%, 97%, 98%, 99%, or 100% sequence identity) to a short fiber-1 protein corresponding to the amino acid sequence of any one of SEQ ID NOs: 120, 121, 123, 124, 126, 127, 129, 131, 133, 134, 136, 138, 140, and 142; (ii) the second fiber protein includes an amino acid sequence having at least 75% sequence identity (e.g., 85%, 95%, 96%, 97%, 98%, 99%, or 100% sequence identity) to a short fiber-2 protein corresponding to the amino acid sequence of any one of SEQ ID NOs: 122, 125, 128, 130, 132, 135, 137, 139, 141, and 143; and (iii) the third fiber protein includes an amino acid sequence having at least 75% sequence identity (e.g., 85%, 95%, 96%, 97%, 98%, 99%, or 100% sequence identity) to a long fiber protein corresponding to the amino acid sequence of any one of SEQ ID NOs: 144-157.

In some embodiments, the nucleotide sequence encoding all or a portion of the hexon protein can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the hexon protein of any one of RhAd54-RhAd67, which corresponds to SEQ ID NOs: 54-67, respectively.

In some embodiments, the nucleotide sequence can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of one or more hexon protein hypervariable regions (HVRs) of RhAd54-RhAd67 (e.g., a HVR delineated in Table 2 of a hexon protein of any one of RhAd54-RhAd67), respectively.

In some embodiments, the one or more nucleotide sequences encoding one or more hexon protein hypervariable regions (HVRs) described herein (e.g., a HVR delineated in Table 2 of a hexon protein of any one of RhAd54-RhAd67) have been substituted with the corresponding HVR sequences of one or more other viruses, e.g., an adenovirus, e.g., an adenovirus that has a lower seroprevalence compared to that of Ad5, such as subgroup B (Ad11, Ad34, Ad35, and Ad50) and subgroup D (Ad15, Ad24, Ad26, Ad48, and Ad49) adenoviruses as well as simian adenoviruses (e.g., Pan9, also known as AdC68). In other embodiments, the nucleotide sequence includes an adenoviral vector backbone of Ad5, Ad11, Ad15, Ad24, Ad26, Ad34, Ad48, Ad49, Ad50, or Pan9/AdC68 having a substitution of all or a portion of one or more of the above hexon HVRs of RhAd54-RhAd67.

In some embodiments, the nucleotide sequence encoding all or a portion of the penton protein can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the penton protein of any one of RhAd54-RhAd67, which corresponds to SEQ ID NOs: 106-119, respectively.

In some embodiments, the isolated polynucleotides include a nucleotide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the knob domains of the short fiber or long fiber proteins of each of RhAd54-RhAd67. In some embodiments, the isolated polynucleotides encode a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domains of the short fiber or long fiber proteins of each of RhAd54-RhAd67.

In some embodiments, the nucleotide sequence encoding all or a portion of the knob domain of the short fiber proteins can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the knob domain of the short fiber proteins (e.g., knob domains of the short fiber-1 and/or short fiber-2) of any one of RhAd54-RhAd67. In some embodiments, the isolated polynucleotides encode a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domains of the short fiber proteins (e.g., knob domains of the short fiber-1 and/or short fiber-2) of any one of RhAd54-RhAd67.

In some embodiments, the nucleotide sequence encoding all or a portion of the knob domain of the short fiber-1 protein can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the knob domain of the short fiber-1 protein of RhAd54-RhAd67, respectively. In some embodiments, the isolated polynucleotide encodes a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domain of the short fiber-1 protein of any one of RhAd54-RhAd67. In some embodiments, the isolated polynucleotide encodes a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domain of the short fiber-1 protein of any one of RhAd54 (SEQ ID NO: 172), RhAd55 (SEQ ID NO: 173), RhAd56 (SEQ ID NO: 175), RhAd57 (SEQ ID NO: 176), RhAd58 (SEQ ID NO: 178), RhAd59 (SEQ ID NO: 179), RhAd61 (SEQ ID NO: 183), or RhAd62 (SEQ ID NO: 185).

In some embodiments, the nucleotide sequence encoding all or a portion of the knob domain of the short fiber-2 protein can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the knob domain of the short fiber-2 protein of RhAd55, RhAd57, RhAd59-RhAd61, and RhAd63-RhAd67, respectively. In some embodiments, the isolated polynucleotides encode a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domain of the short fiber-2 protein of any one of RhAd55, RhAd57, RhAd59-RhAd61, and RhAd63-RhAd67. In some embodiments, the isolated polynucleotides encode a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domain of the short fiber-2 protein of any one of RhAd60 (SEQ ID NO: 182), RhAd63 (SEQ ID NO: 187), RhAd64 (SEQ ID NO: 189), RhAd65 (SEQ ID NO: 191), RhAd66 (SEQ ID NO: 193), or RhAd67 (SEQ ID NO: 195).

In some embodiments, the nucleotide sequence encoding all or a portion of the knob domain of the long fiber protein can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the nucleotide sequence encoding the knob domain of the long fiber protein of any one of RhAd54-RhAd67. In some embodiments, the isolated polynucleotides encode a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domain of the long fiber protein of any one of RhAd54-RhAd67. In some embodiments, the isolated polynucleotides encode a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domain of the long fiber protein of any one of RhAd54-RhAd67, corresponding to SEQ ID NOs: 196-209, respectively.

In some embodiments, one or more nucleotide sequences encoding a knob domain of a fiber protein (e.g., a short fiber or long fiber protein) described herein have been substituted with that of another virus.

In another aspect, featured are recombinant vectors including an isolated polynucleotide of the above aspects. The recombinant vectors include a nucleotide sequence that is at least 90% identical (e.g., at least 91%, 92%, 93%, or 94% identical), at least 95% identical (e.g., at least 96%, 97%, 98%, or 99% identical), or 100% identical to all or a portion of any one of SEQ ID NOs: 224-263. In some embodiments, the vector is an RhAd54 adenoviral vector including all or a portion (e.g., 20 or more consecutive nucleic acids) of SEQ ID NO: 224 or 225. In some embodiments, the vector is an RhAd55 adenoviral vector including all or a portion (e.g., 20 or more consecutive nucleic acids) of SEQ ID NO: 226 or 227. In some embodiments, the vector is an RhAd56 adenoviral vector including all or a portion (e.g., 20 or more consecutive nucleic acids) of any one of SEQ ID NOs: 228-233. In some embodiments, the vector is an RhAd57 adenoviral vector including all or a portion (e.g., 20 or more consecutive nucleic acids) of SEQ ID NO: 224 or 235. In some embodiments, the vector is an RhAd58 adenoviral vector including all or a portion (e.g., 20 or more consecutive nucleic acids) of any one of SEQ ID NOs: 236-239. In some embodiments, the vector is an RhAd59 adenoviral vector including all or a portion (e.g., 20 or more consecutive nucleic acids) of any one of SEQ ID NOs: 240-243. In some embodiments, the vector is an RhAd60 adenoviral vector including all or a portion (e.g., 20 or more consecutive nucleic acids) of SEQ ID NO: 244 or 245. In some embodiments, the vector is an RhAd61 adenoviral vector including all or a portion (e.g., 20 or more consecutive nucleic acids) of SEQ ID NO: 246 or 247. In some embodiments, the vector is an RhAd62 adenoviral vector including all or a portion (e.g., 20 or more consecutive nucleic acids) of SEQ ID NO: 248 or 249. In some embodiments, the vector is an RhAd63 adenoviral vector including all or a portion (e.g., 20 or more consecutive nucleic acids) of SEQ ID NO: 250 or 251. In some embodiments, the vector is an RhAd64 adenoviral vector including all or a portion (e.g., 20 or more consecutive nucleic acids) of SEQ ID NO: 252 or 253. In some embodiments, the vector is an RhAd65 adenoviral vector including all or a portion (e.g., 20 or more consecutive nucleic acids) of SEQ ID NO: 254 or 255. In some embodiments, the vector is an RhAd66 adenoviral vector including all or a portion (e.g., 20 or more consecutive nucleic acids) of any one of SEQ ID NOs: 256-261. In some embodiments, the vector is an RhAd67 adenoviral vector including all or a portion (e.g., 20 or more consecutive nucleic acids) of SEQ ID NOs: 262 or 263. In other embodiments, more than one (e.g., 2, 3, or 4) of the vectors described by SEQ ID NOs: 224-263 may be used to establish a plasmid system for the generation of a recombinant adenovirus described herein.

In some embodiments of any of the above aspects, the isolated polynucleotides and/or recombinant vectors are used to generate recombinant adenoviruses in which all or a portion (e.g., 20 or more consecutive nucleic acids) of the adenoviruses is derived from any one of SEQ ID NOs: 1-14. In some embodiments, the recombinant adenovirus includes an isolated polynucleotide including a deletion in or of the E1 region (e.g., an E1 region defined in Table 3). A recombinant adenoviral vector that includes this deletion is rendered replication-defective. In some embodiments, the replication-defective virus may also include a deletion in or of the E3 region (e.g., an E3 region defined in Table 3). In other embodiments, the recombinant adenovirus includes one or more of the E1, E3, and/or E4 regions (e.g., an E1, E3, and/or E4 region defined in Table 3) and is replication-competent.

In some embodiments, the recombinant adenovirus binds a CAR receptor. In some embodiments, the recombinant adenovirus binds a CD46 or CD55 receptor. In some embodiments, the recombinant adenovirus binds a Coxsackie-adenovirus receptor (CAR). In some embodiments, the recombinant adenovirus binds a sialic acid receptor (CMAS). In some embodiments, the recombinant adenovirus binds a receptor that is not a CAR, CD46, CD55, or sialic acid receptor. In some embodiments, the recombinant adenovirus that binds a sialic acid receptor is encoded by a polynucleotide includes a nucleotide sequence that is at least 90% identical (e.g., at least 91%, 92%, 93%, 94%, 95%, 96%, 97%, 98%, or 99% identical), or 100% identical, to all or a portion (e.g., 20 or more consecutive nucleic acids) of SEQ ID NO: 10 (e.g., RhAd63), or its complement. In some embodiments, the recombinant adenovirus that binds a sialic acid receptor contains three fiber proteins that are at least 85% identical (e.g., at least 86%, 87%, 88%, or 89% identical), 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) to SEQ ID NOs: 134, 135, and 153, respectively.

The recombinant adenovirus may further include a heterologous nucleotide sequence encoding an antigenic or therapeutic gene product of interest, or fragment thereof. The antigenic gene product, or fragment thereof, may be a bacterial, viral, parasitic, or fungal protein, or fragment thereof.

The bacterial protein, or fragment thereof, may be from *Mycobacterium tuberculosis, Mycobacterium bovis, Mycobacterium africanum, Mycobacterium microti, Mycobacterium leprae, Pseudomonas aeruginosa, Salmonella typhimurium, Escherichia coli, Klebsiella pneumoniae, Streptococcus pneumoniae, Staphylococcus aureus, Francisella tularensis, Brucella, Burkholderia mallei, Yersinia pestis, Corynebacterium diphtheria, Neisseria meningitidis, Bordetella pertussis, Clostridium tetani*, or *Bacillus anthracis*. Examples of preferred gene products, or fragments thereof, from *Mycobacterium* strains include 10.4, 85A, 85B, 85C, CFP-10, Rv3871, and ESAT-6 gene products or fragments thereof. Non-limiting examples of bacterial gene products, or fragments thereof, include 10.4, 85A, 85B, 86C, CFP-10, Rv3871, and ESAT-6 gene products, or fragments thereof, of *Mycobacterium*; O, H, and K antigens, or fragments thereof, of *E. coli*; and protective antigen (PA), or fragments thereof, of *Bacillus anthracis*.

The viral protein, or fragment thereof, may be from a virus of the Retroviridae family, which includes the human immunodeficiency virus (HIV; e.g., types 1 and 2), and human T-lymphotropic virus Types I and II (HTLV-1 and HTLV-2, respectively); Flaviviridae family (e.g., a member of the *Flavivirus, Pestivirus*, and *Hepacivirus* genera), which includes the hepatitis C virus (HCV), Yellow fever virus; tick-borne viruses, such as the Gadgets Gully virus, Kadam virus, Kyasanur Forest disease virus, Langat virus, Omsk hemorrhagic fever virus, Powassan virus, Royal Farm virus, Karshi virus, tick-borne encephalitis virus, Neudoerfl virus, Sofjin virus, Louping ill virus and the Negishi virus; seabird tick-borne viruses, such as the Meaban virus, Saumarez Reef virus, and the Tyuleniy virus; mosquito-borne viruses, such as the Aroa virus, dengue virus, Kedougou virus, Cacipacore virus, Koutango virus, Japanese encephalitis virus, Murray Valley encephalitis virus, St. Louis encephalitis virus, Usutu virus, West Nile virus, Yaounde virus, Kokobera virus, Bagaza virus, Ilheus virus, Israel turkey meningoencephalo-myelitis virus, Ntaya virus, Tembusu virus, Zika virus, Banzi virus, Bouboui virus, Edge Hill virus, Jugra virus, Saboya virus, Sepik virus, Uganda S virus, Wesselsbron virus, yellow fever virus; and viruses with no known arthropod vector, such as the Entebbe bat virus, Yokose virus, Apoi virus, Cowbone Ridge virus, Jutiapa virus, Modoc virus, Sal Vieja virus, San Perlita virus, Bukalasa bat virus, Carey Island virus, Dakar bat virus, *Montana myotis* leukoencephalitis virus, Phnom Penh bat virus, Rio Bravo virus, Tamana bat virus, and the Cell fusing agent virus; Arenaviridae family, which includes the Ippy virus, Lassa virus (e.g., the Josiah, LP, or GA391 strain), lymphocytic choriomeningitis virus (LCMV), Mobala virus, Mopeia virus, Amapari virus, Flexal virus, Guanarito virus, Junin virus, Latino virus, Machupo virus, Oliveros virus, Paraná virus, Pichinde virus, Pirital virus, Sabia virus, Tacaribe virus, Tamiami virus, Whitewater Arroyo virus, Chapare virus, and Lujo virus; Bunyaviridae family (e.g., a member of the Hantavirus, Nairovirus, Orthobunyavirus, and Phlebovirus genera), which includes the Hantaan virus, Sin Nombre virus, Dugbe virus, Bunyamwera virus, Rift Valley fever virus, La Crosse virus, Punta Toro virus (PTV), California encephalitis virus, and Crimean-Congo hemorrhagic fever (CCHF) virus; Filoviridae family, which includes the Ebola virus (e.g., the Zaire, Sudan, Ivory Coast, Reston, and Uganda strains) and the Marburg virus (e.g., the Angola, Ci67, Musoke, Popp, Ravn and Lake Victoria strains); Togaviridae family (e.g., a member of the Alphavirus genus), which includes the Venezuelan equine encephalitis virus (VEE), Eastern equine encephalitis virus (EEE), Western equine encephalitis virus (WEE), Sindbis virus, rubella virus, Semliki Forest virus, Ross River virus, Barmah Forest virus, O'nyong'nyong virus, and the chikungunya virus; Poxviridae family (e.g., a member of the Orthopoxvirus genus), which includes the smallpox virus, monkeypox virus, and vaccinia virus; Herpesviridae family, which includes the herpes simplex virus (HSV; types 1, 2, and 6), human herpes virus (e.g., types 7 and 8), cytomegalovirus (CMV), Epstein-Barr virus (EBV), Varicella-Zoster virus, and Kaposi's sarcoma associated-herpesvirus (KSHV); Orthomyxoviridae family, which includes the influenza virus (A, B, and C), such as the H5N1 avian influenza virus or H1 N1 swine flu; Coronaviridae family, which includes the severe acute respiratory syndrome (SARS) virus; Rhabdoviridae family, which includes the rabies virus and vesicular stomatitis virus (VSV); Paramyxoviridae family, which includes the human respiratory syncytial virus (RSV), Newcastle disease virus, hendravirus, nipahvirus, measles virus, rinderpest virus, canine distemper virus, Sendai virus, human parainfluenza virus (e.g., 1, 2, 3, and 4), rhinovirus, and mumps virus; Picornaviridae family, which includes the poliovirus, human enterovirus (A, B, C, and D), hepatitis A virus, and the coxsackievirus; Hepadnaviridae family, which includes the hepatitis B virus; Papillomaviridae family, which includes the human papillomavirus; Parvoviridae family, which includes the adeno-associated virus; Astroviridae family, which includes the astrovirus; Polyomaviridae family, which includes the JC virus, BK virus, and SV40 virus; Calciviridae family, which includes the Norwalk virus; or Reoviridae family, which includes the rotavirus. In a preferred embodiment, the viral protein, or fragment thereof, is from human immunodeficiency virus (HIV), human papillomavirus (HPV), hepatitis A virus (Hep A), hepatitis B virus (HBV), hepatitis C virus (HCV), *Variola major, Variola minor*, monkeypox virus, measles virus, rubella virus, mumps virus, varicella zoster virus (VZV), poliovirus, rabies virus, Japanese encephalitis virus, herpes simplex virus (HSV), cytomegalovirus (CMV), rotavirus, influenza, Ebola virus, yellow fever virus, or Marburg virus.

Non-limiting examples of viral gene products, or fragments thereof, include Gag, Pol, Nef, Tat, Rev, Vif, Vpr, or Vpu, or fragments thereof, of HIV or other viruses, such as other retroviruses (see, e.g., U.S. Pub. No. 2012/0076812, incorporated by reference herein); 9D antigen, or fragments thereof, of HSV; and Env, or fragments thereof, of an enveloped virus. The viral protein, or fragment thereof, may be an Env protein or a structural protein. For example, the viral protein may be an HIV or Zika virus Env protein.

The parasitic protein, or fragment thereof, may be from *Toxoplasma gondii, Plasmodium falciparum, Plasmodium vivax, Plasmodium ovale, Plasmodium malariae, Trypanosoma* spp., or *Legionella* spp. Examples of particularly preferred parasitic proteins that may be cloned into the vectors described herein include those from *Plasmodium falciparum*, such as the circumsporozoite (CS) protein and Liver Specific Antigens 1 or 3 (LSA-1 or LSA-3). Non-limiting examples of parasitic gene products, or fragments thereof, include circumsporozoite (CS) protein, gamete surface proteins Pfs230 and Pfs48/45, and Liver Specific Antigens 1 or 3 (LSA-1 or LSA-3), or fragments thereof, of *Plasmodium falciparum*.

The fungal protein, or fragment thereof, may be from *Aspergillus, Blastomyces dermatitidis, Candida, Coccidioides immitis, Cryptococcus neoformans, Histoplasma capsulatum* var. *capsulatum, Paracoccidioides brasiliensis, Sporothrix schenckii, Zygomycetes* spp., *Absidia corymbifera, Rhizomucor pusillus*, or *Rhizopus arrhizus*. Examples of fungal gene products, or fragments thereof, include any cell wall mannoprotein (e.g., Afmp1 of *Aspergillus fumigatus*) or surface-expressed glycoprotein (e.g., SOWgp of *Coccidioides immitis*). Non-limiting examples of fungal gene products, or fragments thereof, include any cell wall mannoprotein (e.g., Afmp1 of *Aspergillus fumigatus*) or surface-expressed glycoprotein (e.g., SOWgp of *Coccidioides immitis*).

The therapeutic gene products, or fragments thereof, may be interferon (IFN) proteins, Factor VIII, Factor IX, erythropoietin, alpha-1 antitrypsin, calcitonin, glucocerebrosidase, growth hormone, low density lipoprotein (LDL), receptor IL-2 receptor and its antagonists, insulin, globin, immunoglobulins, catalytic antibodies, the interleukins, insulin-like growth factors, superoxide dismutase, immune responder modifiers, parathyroid hormone and interferon, nerve growth factors, tissue plasminogen activators, and/or colony stimulating factors, or fragments thereof.

In some embodiments, the therapeutic gene product is a cancer antigen or tumor-associated antigen (e.g., one or more cancer antigens or tumor-associated antigens listed in the Appendix).

In another aspect, featured is a method of treating a subject (e.g., a human) having a disease (e.g., an infection by one of the infective agents described above, such as HIV, or cancer) by administering a recombinant RhAd adenovirus vector described herein to the subject. In a preferred embodiment, the recombinant RhAd adenovirus includes an antigenic gene product, or fragment thereof, that promotes an immune response against an infective agent in a subject at risk of exposure to, or exposed to, the infective agent. In some embodiments, the infective agent is a bacterium, a virus, a parasite, or a fungus, such as those described above. In one non-limiting example, the administration of a RhAd adenovirus described herein expressing an HIV Gag protein, or fragment thereof, to an HIV-positive subject or a subject with acquired immune deficiency syndrome (AIDS) can stimulate an immune response in the subject against HIV, thereby treating the subject. In another embodiment, the recombinant RhAd adenovirus described herein includes a therapeutic gene product, or fragment thereof, such as an interferon (IFN) protein, or fragment thereof, that provides therapy to a subject having a disease caused by a non-infective agent, such as cancer, by stimulating a favorable immune response in the subject against neoplasia and/or by providing gene therapy, thereby treating the subject. Other non-limiting examples of diseases that may be treated include any human health disease, such as tuberculosis, leprosy, typhoid fever, pneumonia, meningitis, staphylococcal scalded skin syndrome (SSSS), Ritter's disease, tularemia (rabbit fever), brucellosis, Glanders disease, bubonic plague, septicemic plague, pneumonic plague, diphtheria, pertussis (whooping cough), tetanus, anthrax, hepatitis, smallpox, monkeypox, measles, mumps, rubella, chicken pox, polio, rabies, Japanese encephalitis, herpes, mononucleosis, influenza, Ebola virus disease, hemorrhagic fever, yellow fever, Marburg virus disease, toxoplasmosis, malaria, trypanosomiasis, legionellosis, aspergillosis, blastomycosis, candidiasis (thrush), coccidioidomycosis, cryptococcosis, histoplasmosis, paracoccidioidomycosis, sporotrichosis, or sinus-orbital zygomycosis. Treatment of these diseases may be by administration of a recombinant RhAd vector described herein that encodes or expresses on its surface an immune response-stimulating antigen from the selected infective agent. For example, an immune response may include upregulation (e.g., upregulation by a log fold change of about +1, +2, +3, +4, +5, +6, +7, +8, +9, +10, +11, +12, +13, +14, or +15) or downregulation (e.g., downregulation by a log fold change of about −1, −2, −3, −4, −5, −6, −7, −8, −9, −10, −11, −12, −13, −14, or −15) of pro-inflammatory signaling pathways, TCR signaling pathways, BCR signaling pathways, T-help cells markers, NK cells activation markers, growth factors, T cell proliferation and differentiation markers, program cell death markers, NFKB signaling markers, STAT signaling markers, TGF-beta signaling markers, or negative immune regulators. In some instances, an immune response may include upregulation (e.g., upregulation by a log fold change of about +1, +2, +3, +4, +5, +6, +7, +8, +9, +10, +11, +12, +13, +14, or +15) or downregulation (e.g., downregulation by a log fold change of about −1, −2, −3, −4, −5, −6, −7, −8, −9, −10, −11, −12, −13, −14, or −15) of factors, such as, e.g., one or more of TNF-α, IL1-α, IL1β, IL-2, Il-2ra, IL-4, IL-5, IL-6, IL-7, IL-9, IL-10, IL-13, IL-15, IP10 (CXCL10), IL-12 (P40), IL-12 (P70), IL-18, Eotaxin (CCL11), KC (CXCL1), MCP-1 (CCL2), MIP-1a (CCL3), MIP-1b (CCL4), MIP2 (CXCL2), MIG (CXCR3), LIX (CXCL5), RANTES (CCL5), IFN-γ, G-CSF, CCL19, CXCL11, GM-CSF, CD40, CD40LG, NFATC3, NFATC4, CD28, CCR4, CD34, CD38, CD3e, CD4, CD68, CD80, CD86, CD8a, LY96, VCAM1, C3, CD19, ICOS, TBX21, IL-15, VEGF, CSF1, CSF2, CSF3, BCL2, BCL2L1, AGTR2, BAX, FAS, FASL, GZMB, LCAM1, PRF1, SOCS1, SOCS2, Tnfrsf18, NFKB1, NFKB2, IKBKB, Stat1, Stat2, Stat3, STAT4, STATE, SMAD3, SMAD7, TGFB1, CTLA4, ACE, EDN1, FN1, H2-Ea, H2-Eb1, LIF, LRP2, NOS2, PTGS2, PTPRC, SELE, SELP, or SKI (see, e.g., the methodology of Example 1). In some embodiments, the recombinant adenoviruses (e.g., RhAd55, RhAd58, RhAd59, RhAd62, RhAd65, and RhAd66) described herein may induce an immune response that involves downregulation of IL-9 relative to a reference level. In some embodiments, the recombinant adenovirus or adenoviral vector is administered intramuscularly, intravenously, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctivally, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in cremes, or in lipid compositions. In one preferred embodiment, the recombinant adenovirus or adenoviral vector is administered as a pharmaceutical composition that includes a pharmaceutically acceptable carrier, diluent, or excipients, and may optionally include an adjuvant. In some embodiments, the subject is administered at least one dose (e.g., 1, 2, 3, 4, 5, 6, 7, 8, 9, 10, or more doses) of the composition. In other embodiments, the subject is administered at least two doses (e.g., 2, 3, 4, 5, 6, 7, 8, 9, 10, or more doses) of the composition.

In yet another embodiment, the pharmaceutical composition is administered to the subject as a prime composition, a boost composition, a prime-boost composition or in a prime-boost regimen, including a priming step followed by a boosting step. In other embodiments, the prime-boost regimen may be a homologous prime-boost regimen or a heterologous prime-boost regimen. In some embodiments, the prime-boost regimen is a homologous prime-boost regimen, wherein the priming step and the boosting step includes administration of the pharmaceutical composition. In some embodiments, the prime-boost regimen is a heterologous prime-boost regimen, wherein the priming step includes administration of the pharmaceutical composition. In some embodiments, the boosting step includes administration of a second, different pharmaceutical composition, wherein optionally the second pharmaceutical composition includes a second recombinant adenovirus, a recombinant vector, a polynucleotide, or a polypeptide. In some embodiments, the second pharmaceutical composition includes a RhAd vector (e.g., RhAd51, RhAd52, or RhAd53 vector) or a HuAd (e.g., HuAd5) vector. In some embodiments, the prime-boost regimen is a heterologous prime-boost regimen, wherein the boosting step includes administration of the pharmaceutical composition. In some embodiments, the priming step includes administration of a second, different pharmaceutical composition, wherein optionally the second pharmaceutical composition includes a second recombinant adenovirus, a recombinant vector, a polynucleotide, or a polypeptide. In some embodiments, the second pharmaceutical composition includes a RhAd vector (e.g., RhAd51, RhAd52, or RhAd53 vector) or a HuAd (e.g., HuAd5) vector.

The subject can be administered at least about $1 \times 10^3$ viral particles (vp)/dose or between $1 \times 10^1$ and $1 \times 10^{14}$ vp/dose, preferably between $1 \times 10^3$ and $1 \times 10^{12}$ vp/dose, and more preferably between $1 \times 10^5$ and $1 \times 10^{11}$ vp/dose. The pharmaceutical composition may be administered, for example, 1, 2, 3, 4, 5, 6, 7, 8, 9, 10, 15, 20, 30, 35, 40, 45, 50, 55, or 60 minutes, 2, 4, 6, 10, 15, or 24 hours, 2, 3, 5, or 7 days, 2, 4, 6 or 8 weeks, or even 3, 4, or 6 months pre-exposure or pre-diagnosis, or may be administered to the subject 15-30 minutes or 1, 2, 3, 4, 5, 6, 7, 8, 9, 10, 12, 20, 24, 48, or 72 hours, 2, 3, 5, or 7 days, 2, 4, 6 or 8 weeks, 3, 4, 6, or 9 months, 1, 2, 3, 4, 5, 6, 7, 8, 9, 10, 15, 20 years or longer post-diagnosis or post-exposure or to the infective agent. When treating disease (e.g., an infection, such as a viral infection (e.g., HIV), or cancer), the pharmaceutical compositions described herein may be administered to the subject either before the occurrence of symptoms or a definitive diagnosis or after diagnosis or symptoms become evident. The pharmaceutical composition may be administered, for example, immediately after diagnosis or the clinical recognition of symptoms or 2, 4, 6, 10, 15, or 24 hours, 2, 3, 5, or 7 days, 2, 4, 6 or 8 weeks, or even 3, 4, or 6 months after diagnosis or detection of symptoms.

In another aspect, featured is a method of producing a recombinant adenovirus described herein that includes culturing a cell in a suitable medium; transfecting the cell with an isolated polynucleotide described herein or a recombinant vector described herein; allowing replication of the polynucleotide or vector in the cell; and harvesting the produced recombinant adenovirus from the medium and/or cell. In some embodiments, the cell is a bacterial, plant, or mammalian cell. In a preferred embodiment, the mammalian cell is a Chinese hamster ovary (CHO) cell.

Definitions

By "adenovirus" is meant a medium-sized (90-100 nm), nonenveloped icosahedral virus that includes a capsid and a double-stranded linear DNA genome. The adenovirus can be a naturally occurring, but isolated, adenovirus (e.g., RhAd54-RhAd67) or a recombinant adenovirus (e.g., replication-defective or replication competent RhAd54-RhAd67, or a chimeric variant thereof).

As used herein, by "administering" is meant a method of giving a dosage of a pharmaceutical composition (e.g., a recombinant adenovirus described herein) to a subject. The compositions utilized in the methods described herein can be administered, for example, intramuscularly, intravenously, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctivally, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in cremes, or in lipid compositions. The preferred method of administration can vary depending on various factors (e.g., the components of the composition being administered and the severity of the condition being treated).

The term "cancer" refers to any cancer caused by the proliferation of malignant neoplastic cells, such as tumors, neoplasms, carcinomas, sarcomas, leukemias, and lymphomas. A "solid tumor cancer" is a cancer comprising an abnormal mass of tissue, e.g., sarcomas, carcinomas, and lymphomas. A "hematological cancer" or "liquid cancer," as used interchangeably herein, is a cancer present in a body fluid, e.g., lymphomas and leukemias.

Throughout this specification and claims, the word "comprise," or variations such as "comprises" or "comprising," will be understood to imply the inclusion of a stated integer or group of integers but not the exclusion of any other integer or group of integers.

By "deletion" of an adenoviral genomic region is meant the partial or complete removal, the disruption (e.g., by an insertion mutation), or the functional inactivation (e.g., by a missense mutation) of a specified genomic region (e.g., the E1, E2, E3, and/or E4 region), or any specific open-reading frame within the specified region.

By "gene product" is meant to include mRNAs or other nucleic acids (e.g., microRNAs) transcribed from a gene, as well as polypeptides translated from those mRNAs. In some embodiments, the gene product is from a virus (e.g., HIV) and many include, for example, any one or more of the viral proteins, or fragments thereof, described in, for example, pending U.S. Pub. No. 2012/0076812. In some embodiments, the gene product is a therapeutic gene product, including, but not limited to, interferon proteins, Factor VIII, Factor IX, erythropoietin, alpha-1 antitrypsin, calcitonin, glucocerebrosidase, growth hormone, low density lipoprotein (LDL), receptor IL-2 receptor and its antagonists, insulin, globin, immunoglobulins, catalytic antibodies, the interleukins, insulin-like growth factors, superoxide dismutase, immune responder modifiers, parathyroid hormone and interferon, nerve growth factors, tissue plasminogen activators, and colony stimulating factors.

By "heterologous nucleic acid molecule" is meant any exogenous nucleic acid molecule that can be incorporated into, for example, an adenovirus described herein, or polynucleotide or vector thereof, for subsequent expression of a gene product of interest, or fragment thereof, encoded by the heterologous nucleic acid molecule. In a preferred embodiment, the heterologous nucleic acid molecule encodes an antigenic or therapeutic gene product, or fragment thereof, that is a bacterial, viral, parasitic, or fungal protein, or fragment thereof (e.g., a nucleic acid molecule encoding one or more HIV or SIV Gag, Pol, Env, Nef, Tat, Rev, Vif, Vpr, or Vpu gene products, or fragments thereof, a cancer antigen (e.g., as described in the appendix), or a therapeutic gene product known in the art (e.g., see immunogens listed in U.S. Pat. No. 8,394,386, incorporated herein by reference). The heterologous nucleic acid molecule is one that is not normally associated with the other nucleic acid molecules found in the wild-type adenovirus.

By "isolated" is meant separated, recovered, or purified (e.g., 90%, 91%, 92%, 93%, 94%, 95%, 96%, 97%, 98%, 99%, or 100% pure) from a component of its natural environment.

By "pharmaceutical composition" is meant any composition that contains a therapeutically or biologically active agent, such as a recombinant adenoviral vector described herein, preferably including a heterologous nucleotide sequence encoding an antigenic or therapeutic gene product of interest, or fragment thereof, that is suitable for administration to a subject and that treats a disease (e.g., cancer, AIDS, or Zika infection) or reduces or ameliorates one or more symptoms of the disease. For the purposes of this invention, pharmaceutical compositions include vaccines, and pharmaceutical compositions suitable for delivering a therapeutic or biologically active agent can include, for example, tablets, gelcaps, capsules, pills, powders, granulates, suspensions, emulsions, solutions, gels, hydrogels, oral gels, pastes, eye drops, ointments, creams, plasters, drenches, delivery devices, suppositories, enemas, injectables, implants, sprays, or aerosols. Any of these formulations can be prepared by well-known and accepted methods of art. See, for example, *Remington: The Science and Practice of Pharmacy* (21$^{st}$ ed.), ed. A. R. Gennaro, Lippincott Williams & Wilkins, 2005, and *Encyclopedia of Pharmaceutical Technology*, ed. J. Swarbrick, Informa Healthcare, 2006, each of which is hereby incorporated by reference.

By "pharmaceutically acceptable diluent, excipient, carrier, or adjuvant" is meant a diluent, excipient, carrier, or adjuvant which is physiologically acceptable to the subject while retaining the therapeutic properties of the pharmaceutical composition with which it is administered. One exemplary pharmaceutically acceptable carrier is physiological saline. Other physiologically acceptable diluents, excipients, carriers, or adjuvants and their formulations are known to one skilled in the art (see, e.g., U.S. Pub. No. 2012/0076812).

By "part," "portion," or "fragment," as used interchangeably herein, is meant a less than a whole of a reference sequence. A part, portion, or fragment may comprise, e.g., at least 10%, 20%, 30%, 40%, 50%, 60%, 70%, 80%, 90%, or 95% of the entire length of a polynucleotide or polypeptide sequence region. For polynucleotides, for example, a part, portion, or fragment may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10000, 15000, 20000, 25000, 30000, 35000 or more contiguous nucleotides of a reference polynucleotide molecule. For polypeptides, for example, a part, portion, or fragment may include at least 5, 6, 7, 8, 9, 10, 11, 12, 13, 14, 15, 16, 17, 18, 19, 20, 25, 50, 75, 90, 100, 125, 150, 175, 200, 225, 250, 275, 300, or 350 or more contiguous amino acids of a reference polypeptide molecule.

By "promotes an immune response" is meant eliciting a humoral response (e.g., the production of antibodies) or a cellular response (e.g., the activation of T cells, macrophages, neutrophils, and natural killer cells) directed against, for example, one or more infective agents (e.g., a bacterium, virus, parasite, fungus, or combination thereof) or protein targets in a subject to which the pharmaceutical composition (e.g., a vaccine) has been administered. Immune responses include both cell-mediated immune responses (i.e., responses mediated by antigen-specific and non-specific T-cells, such as CD8$^+$ T-cells, Th1 cells, Th2 cells, and Th17 cells) as well as humoral immune responses (i.e., responses characterized by B-cell activation and the production of antigen-specific antibodies). The term "immune response" encompasses both the innate immune responses to an antigen (e.g., a tumor-associated antigen), as well as memory responses that are a result of acquired immunity. For example, an immune response may include upregulation (e.g., upregulation by a log fold change of about +1, +2, +3, +4, +5, +6, +7, +8, +9, +10, +11, +12, +13, +14, or +15) or downregulation (e.g., downregulation by a log fold change of about −1, −2, −3, −4, −5, −6, −7, −8, −9, −10, −11, −12, −13, −14, or −15) of pro-inflammatory signaling pathways, TCR signaling pathways, BCR signaling pathways, T-help cells markers, NK cells activation markers, growth factors, T cell proliferation and differentiation markers, program cell death markers, NFKB signaling markers, STAT signaling markers, TGF-beta signaling markers, or negative immune regulators. In some instances, an immune response may include upregulation (e.g., upregulation by a log fold change of about +1, +2, +3, +4, +5, +6, +7, +8, +9, +10, +11, +12, +13, +14, or +15) or downregulation (e.g., downregulation by a log fold change of about −1, −2, −3, −4, −5, −6, −7, −8, −9, −10, −11, −12, −13, −14, or −15) of factors, such as, e.g., one or more of TNF-α, IL1-α, IL1β, IL-2, Il-2ra, IL-4, IL-5, IL-6, IL-7, IL-9, IL-10, IL-13, IL-15, IP10 (CXCL10), IL-12 (P40), IL-12 (P70), IL-18, Eotaxin (CCL11), KC (CXCL1), MCP-1 (CCL2), MIP-1a (CCL3), MIP-1b (CCL4), MIP2 (CXCL2), MIG (CXCR3), LIX (CXCL5), RANTES (CCL5), IFN-γ, G-CSF, CCL19, CXCL11, GM-CSF, CD40, CD40LG, NFATC3, NFATC4, CD28, CCR4, CD34, CD38, CD3e, CD4, CD68, CD80, CD86, CD8a, LY96, VCAM1, C3, CD19, ICOS, TBX21, IL-15, VEGF, CSF1, CSF2, CSF3, BCL2, BCL2L1, AGTR2, BAX, FAS, FASL, GZMB, LCAM1, PRF1, SOCS1, SOCS2, Tnfrsf18, NFKB1, NFKB2, IKBKB, Stat1, Stat2, Stat3, STAT4, STATE, SMAD3, SMAD7, TGFB1, CTLA4, ACE, EDN1, FN1, H2-Ea, H2-Eb1, LIF, LRP2, NOS2, PTGS2, PTPRC, SELE, SELP, or SKI (see, e.g., the methodology of Example 1). For example, the recombinant adenoviruses (e.g., RhAd55, RhAd58, RhAd59, RhAd62, RhAd65, and RhAd66) described herein may induce an immune response that involves downregulation of IL-9 relative to a reference level.

By "recombinant," with respect to a vector or virus, is meant a vector or virus that has been manipulated in vitro, such as a vector or virus that includes a heterologous nucleotide sequence (e.g., a sequence encoding an antigenic or therapeutic gene product) or a vector or virus bearing an alteration, disruption, or deletion in the vector or virus, such as an alteration, disruption, or deletion in a viral E1, E3, and/or E4 region, relative to a wild-type vector or virus.

By "sequence identity" or "sequence similarity" is meant that the identity or similarity between two or more amino acid sequences, or two or more nucleotide sequences, is expressed in terms of the identity or similarity between the sequences. Sequence identity can be measured in terms of "percentage (%) identity," wherein the higher the percentage, the more identity shared between the sequences. Sequence similarity can be measured in terms of percentage similarity (which takes into account conservative amino acid substitutions); the higher the percentage, the more similarity shared between the sequences. Homologs or orthologs of nucleic acid or amino acid sequences possess a relatively high degree of sequence identity/similarity when aligned using standard methods. Sequence identity may be measured using sequence analysis software on the default setting (e.g., Sequence Analysis Software Package of the Genetics Computer Group, University of Wisconsin Biotechnology Center, 1710 University Avenue, Madison, Wis. 53705). Such software may match similar sequences by assigning degrees of homology to various substitutions, deletions, and other modifications.

A "subject" is a vertebrate, such as a mammal (e.g., primates and humans). Mammals also include, but are not limited to, farm animals (such as cows), sport animals (e.g., horses), pets (such as cats and dogs), mice, and rats. A subject to be treated according to the methods described herein (e.g., a subject having a disease such as cancer and/or a disease caused by an infective agent, e.g., a bacterium, virus, fungus, or parasite) may be one who has been diagnosed by a medical practitioner as having such a condition. Diagnosis may be performed by any suitable means. A subject in whom the development of an infection is being prevented may or may not have received such a diagnosis. One skilled in the art will understand that a subject to be treated according to the present invention may have been subjected to standard tests or may have been identified, without examination, as one at high risk due to the presence of one or more risk factors (e.g., exposure to a biological agent, such as a virus).

As used herein, and as well understood in the art, "treatment" is an approach for obtaining beneficial or desired results, such as clinical results. Beneficial or desired results can include, but are not limited to, alleviation or amelioration of one or more symptoms or conditions; diminishment of extent of disease, disorder, or condition; stabilization (i.e., not worsening) of a state of disease, disorder, or condition; prevention of spread of disease, disorder, or condition; delay or slowing the progress of the disease, disorder, or condition; amelioration or palliation of the disease, disorder, or condition; and remission (whether partial or total), whether detectable or undetectable. "Palliating" a disease, disorder, or condition means that the extent and/or undesirable clinical manifestations of the disease, disorder, or condition are lessened and/or time course of the progression is slowed or lengthened, as compared to the extent or time course in the absence of treatment.

The term "vaccine," as used herein, is defined as material used to provoke an immune response and may confer immunity after administration of the vaccine to a subject.

By "vector" is meant a composition that includes one or more genes (non-structural or structural), or fragments thereof, from a viral species, such as an adenoviral species (e.g., RhAd54-RhAd67), that may be used to transmit one or more heterologous genes from a viral or non-viral source to a host or subject. The nucleic acid material of the viral vector may be encapsulated, e.g., in a lipid membrane or by structural proteins (e.g., capsid proteins), that may include one or more viral polypeptides (e.g., a glycoprotein). The viral vector can be used to infect cells of a subject, which, in turn, promotes the translation of the heterologous gene(s) of the viral vector into a protein product.

The term "virus," as used herein, is defined as an infectious agent that is unable to grow or reproduce outside a host cell and that infects mammals (e.g., humans) or birds.

The term "consensus sequence, as used herein, is defined as a single sequence (e.g., an amino acid sequence of a polypeptide) which represents a collective population of sequences allowing for variability at one or more sites.

Other features and advantages described herein will be apparent from the following Detailed Description, the drawings, and the claims.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 2B is a photograph showing a representative gel of PCR fragments used to assemble the final recombinant Rhesus adenovirus constructs.

FIG. 2C is a photograph showing a gel from the screening of AdApter plasmids by restriction enzyme digestion. A higher percentage of positive clones for the AdApter plasmid were identified as compared to the cosmid (see FIG. 2D). Positive clones with expected banding pattern are boxed.

FIG. 2D is a photograph showing a gel from the screening of cosmids by restriction enzyme digestion. Positive clones with expected banding pattern are boxed.

FIG. 46A depicts amino acid residues 1-160 of the sequence alignment. FIG. 46B depicts amino acid residues 161-320 of the alignment. FIG. 46C depicts amino acid residues 321-480 of the alignment. FIG. 46D depicts amino acid residues 481-561 of the alignment.

FIGS. 47A-47B are a series of images depicting an alignment of the polypeptide sequences of the short fiber-1 proteins of RhAd55, RhAd57, RhAd59-61, and RhAd63-67, which correspond to SEQ ID NOs: 121, 124, 127, 129, 131, 134, 136, 138, 140, and 142, respectively. A consensus sequence corresponding to the alignment of the short fiber-1 proteins of RhAd55, RhAd57, RhAd59-61, and RhAd63-67 is also provided (SEQ ID NO: 265). FIG. 47A depicts amino acid residues 1-160 of the sequence alignment. FIG. 47B depicts amino acid residues 161-315 of the alignment.

FIG. 48A depicts amino acid residues 1-160 of the sequence alignment. FIG. 48B depicts amino acid residues 161-320 of the alignment. FIG. 48C depicts amino acid residues 321-363 of the alignment.

FIGS. 49A-49B are a series of images depicting an alignment of the polypeptide sequences of the long fiber proteins of RhAd56-59, RhAd62, and RhAd66, which correspond to SEQ ID NOs: 146-149, 152, and 156, respectively. A consensus sequence corresponding to the alignment of the long fiber proteins of RhAd56-59, RhAd62, and RhAd66 is also provided (SEQ ID NO: 267). FIG. 49A depicts amino acid residues 1-240 of the sequence alignment. FIG. 49B depicts amino acid residues 241-560 of the alignment.

FIG. 51A depicts amino acid residues 1-160 of the sequence alignment. FIG. 51B depicts amino acid residues 161-320 of the alignment. FIG. 51C depicts amino acid residues 321-480 of the alignment. FIG. 51D depicts amino acid residues 481-506 of the alignment.

FIG. 52A depicts amino acid residues 1-240 of the sequence alignment. FIG. 52B depicts amino acid residues 241-506 of the alignment.

Figure 53C:
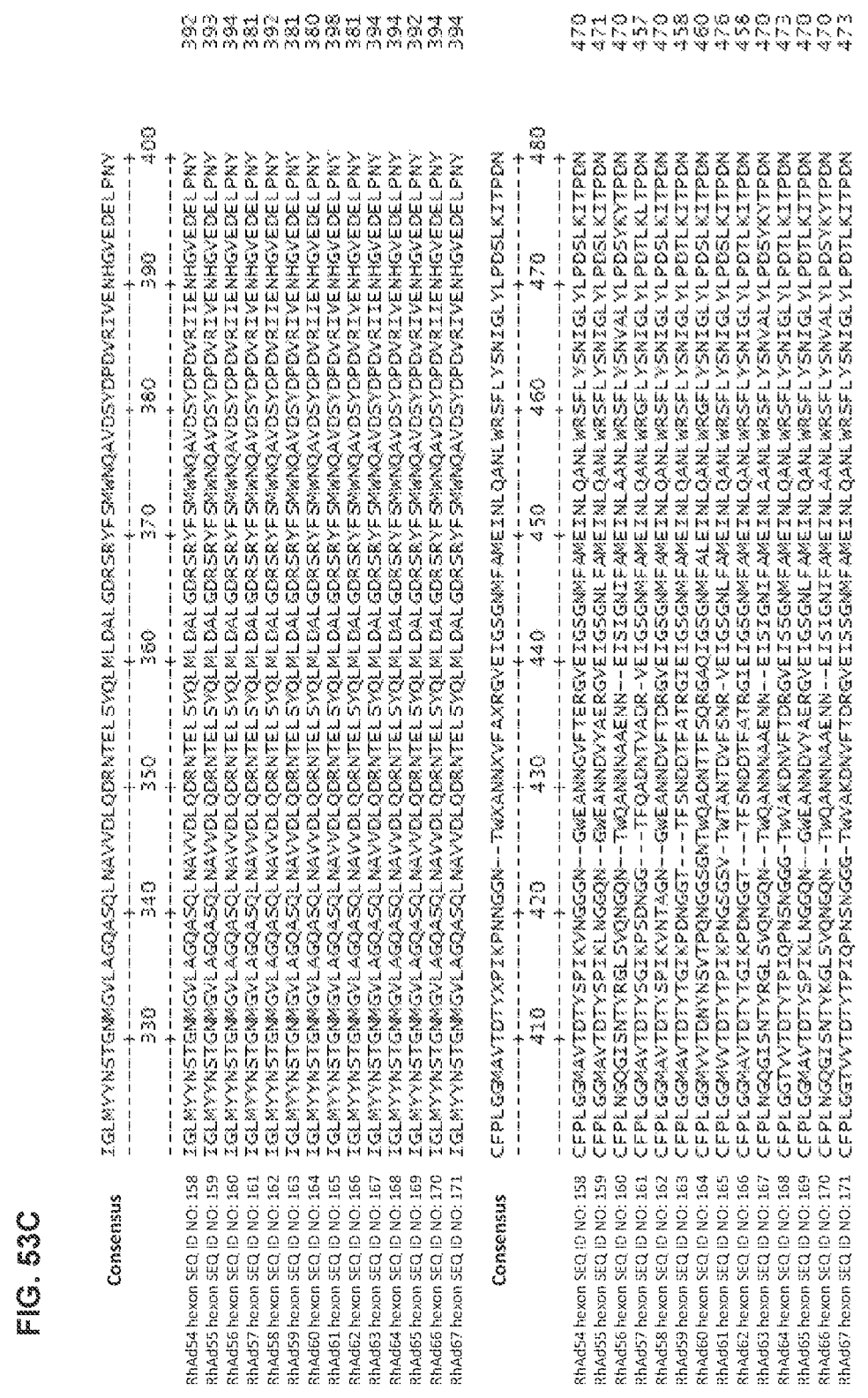

FIGS. 53A-53F are a series of images depicting an alignment of the polypeptide sequences of the hexon proteins of RhAd54-RhAd67, which correspond to SEQ ID NOs: 158-171, respectively. A consensus sequence corresponding to the alignment of the hexon proteins of RhAd54-RhAd67 is also provided (SEQ ID NO: 271). FIG. 53A depicts amino acid residues 1-160 of the sequence alignment. FIG. 53B depicts amino acid residues 161-320 of the alignment. FIG. 53C depicts amino acid residues 321-480 of the alignment. FIG. 53D depicts amino acid residues 481-560 of the alignment. FIG. 53E depicts amino acid residues 561-800 of the alignment. FIG. 53F depicts amino acid residues 801-942 of the alignment.

FIGS. 54A-54C are a series of images depicting an alignment of the polypeptide sequences of the hexon proteins of RhAd56-59, RhAd62, and RhAd66, which correspond to SEQ ID NOs: 160-163, 166, and 170 respectively. A consensus sequence corresponding to the alignment of the hexon proteins of RhAd56-59, RhAd62, and RhAd66 is also provided (SEQ ID NO: 272). FIG. 54A depicts amino acid residues 1-320 of the sequence alignment. FIG. 54B depicts amino acid residues 321-640 of the alignment. FIG. 54C depicts amino acid residues 641-938 of the alignment.

DETAILED DESCRIPTION

Figure 1A:
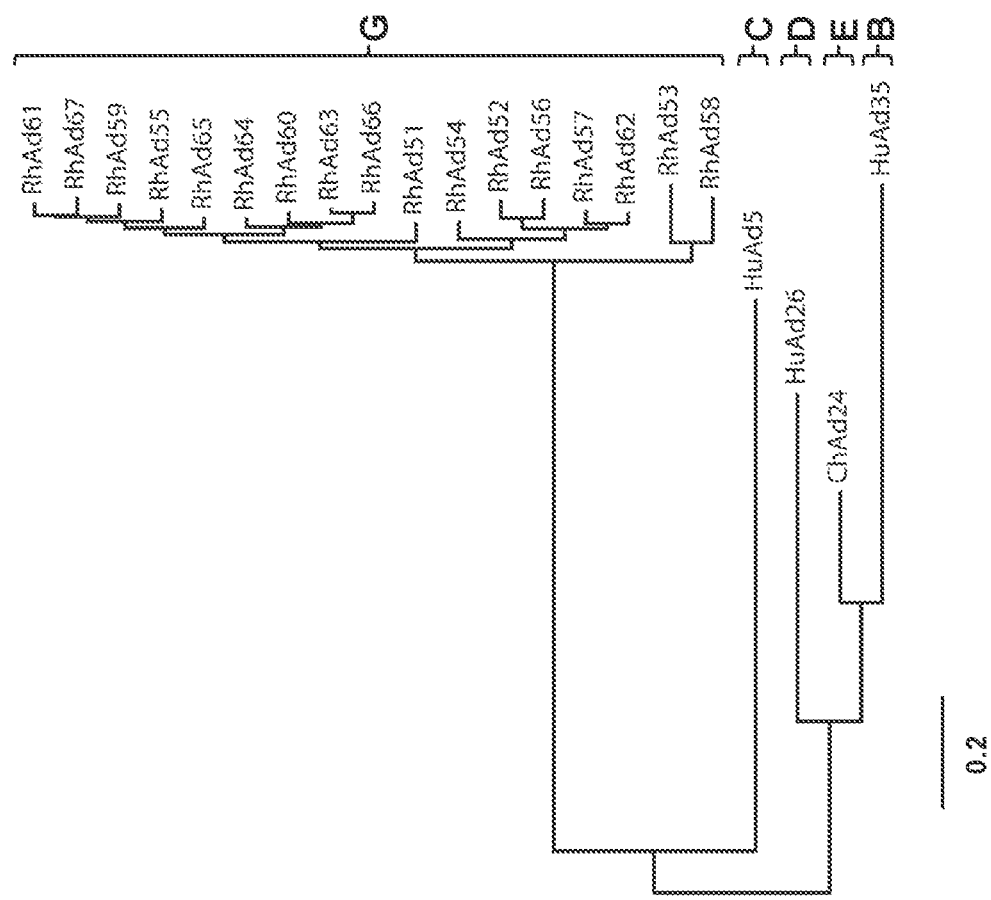
FIG. 1A is a schematic showing a maximum likelihood phylogenetic tree for rhesus, human, and chimpanzee adenovirus for complete genomes generated using PhyML 3.1/3.0 aLRT. DNA sequences were Multiple Sequence Comparison by Log-Expectation (MUSCLE) aligned and placed into a tree with TreeDyn 198.3. The trees are drawn to scale, with branch lengths measured in the number of substitutions per site.

We discovered fourteen rhesus adenoviruses (RhAds): RhAd54 (RhAd4282), RhAd55 (RhAd4300), RhAd56 (RhAd4302), RhAd57 (RhAd4305), RhAd58 (RhAd4308), RhAd59 (RhAd4309), RhAd60 (RhAd4310B), RhAd61 (RhAd6665), RhAd62 (RhAd6666), RhAd63 (RhAd6668A), RhAd64 (RhAd6668B), RhAd65 (RhAd6669), RhAd66 (RhAd6672), and RhAd67 (RhAd6673) (i.e., RhAd54-RhAd67).

The complete genome sequence of the RhAds, as well as the vector systems we generated for each of the viruses is described in detail below. The vector systems generated from recombinant RhAd54 (RhAd4282), RhAd55 (RhAd4300), RhAd56 (RhAd4302), RhAd57 (RhAd4305), RhAd58 (RhAd4308), RhAd59 (RhAd4309), RhAd60 (RhAd4310B), RhAd61 (RhAd6665), RhAd62 (RhAd6666), RhAd63 (RhAd6668A), RhAd64 (RhAd6668B), RhAd65 (RhAd6669), RhAd66 (RhAd6672), and RhAd67 (RhAd6673) (i.e., RhAd54-RhAd67) can be used to express a variety of heterologous polypeptides, including e.g., antigens from one or more pathogens or infective agents (e.g., from HIV, tuberculosis, Zika virus, respiratory syncytial virus, and Ebola virus, as well as cancer antigens. In addition, these vectors (i) have extremely and surprisingly low seroprevalence in human populations and (ii) exhibit potent immunogenicity, e.g., when used to express a heterologous polypeptide, such as an antigenic polypeptide. This combination of low baseline anti-vector immunity and potent immunogenicity suggests that these adenoviral vectors can be useful in the generation of vaccines against diseases, such as cancer and those caused by an infective agent (e.g., HIV or Zika infection).

Polynucleotides and Polypeptides

Featured are polynucleotide sequences related to the fourteen RhAds (RhAd54 (RhAd4282), RhAd55 (RhAd4300), RhAd56 (RhAd4302), RhAd57 (RhAd4305), RhAd58 (RhAd4308), RhAd59 (RhAd4309), RhAd60 (RhAd4310B), RhAd61 (RhAd6665), RhAd62 (RhAd6666), RhAd63 (RhAd6668A), RhAd64 (RhAd6668B), RhAd65 (RhAd6669), RhAd66 (RhAd6672), and RhAd67 (RhAd6673) (i.e., RhAd54-RhAd67)). The isolated polynucleotides may include a nucleotide sequence that is at least 90% identical (e.g., at least 91%, 92%, 93%, or 94% identical), at least 95% identical (e.g., at least 96%, 97%, 98%, or 99% identical), or 100% identical to all or a portion of the full-length genome sequence of one or more of RhAd54 (SEQ ID NO: 1), RhAd55 (SEQ ID NO: 2), RhAd56 (SEQ ID NO: 3), RhAd57 (SEQ ID NO: 4), RhAd58 (SEQ ID NO: 5), RhAd59 (SEQ ID NO: 6), RhAd60 (SEQ ID NO: 7), RhAd61 (SEQ ID NO: 8), RhAd62 (SEQ ID NO: 9); RhAd63 (SEQ ID NO: 10), RhAd64 (SEQ ID NO: 11), RhAd65 (SEQ ID NO: 12), RhAd66 (SEQ ID NO: 13), and RhAd67 (SEQ ID NO: 14), or their complement. The isolated polynucleotides described herein may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, 10000, 15000, 20000, 25000, 30000, 35000 or more contiguous or non-contiguous nucleotides of SEQ ID NOs: 1-14.

Polynucleotides described herein also include all or a portion of the nucleotide sequence encoding the short fiber protein, long fiber protein, penton protein, and/or hexon protein of one or more of RhAd54-RhAd67. In particular, the nucleotide sequence encoding the short fiber protein can be at least 90% identical (e.g., at least 91%, 92%, 93%, or 94% identical), at least 95% identical (e.g., at least 96%, 97%, 98%, or 99% identical), or 100% identical to all or a portion of any one of SEQ ID NOs: 16-39, which corresponds to the nucleotide sequence encoding the short fiber protein (e.g., short fiber-1 and/or short fiber-2) of RhAd54-RhAd67, respectively. The polypeptide sequences of the short fiber protein (e.g., short fiber-1 or short fiber-2) of RhAd54-RhAd67 correspond to SEQ ID NOs: 120-143, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of SEQ ID NOs: 120-143.

Figure 50:
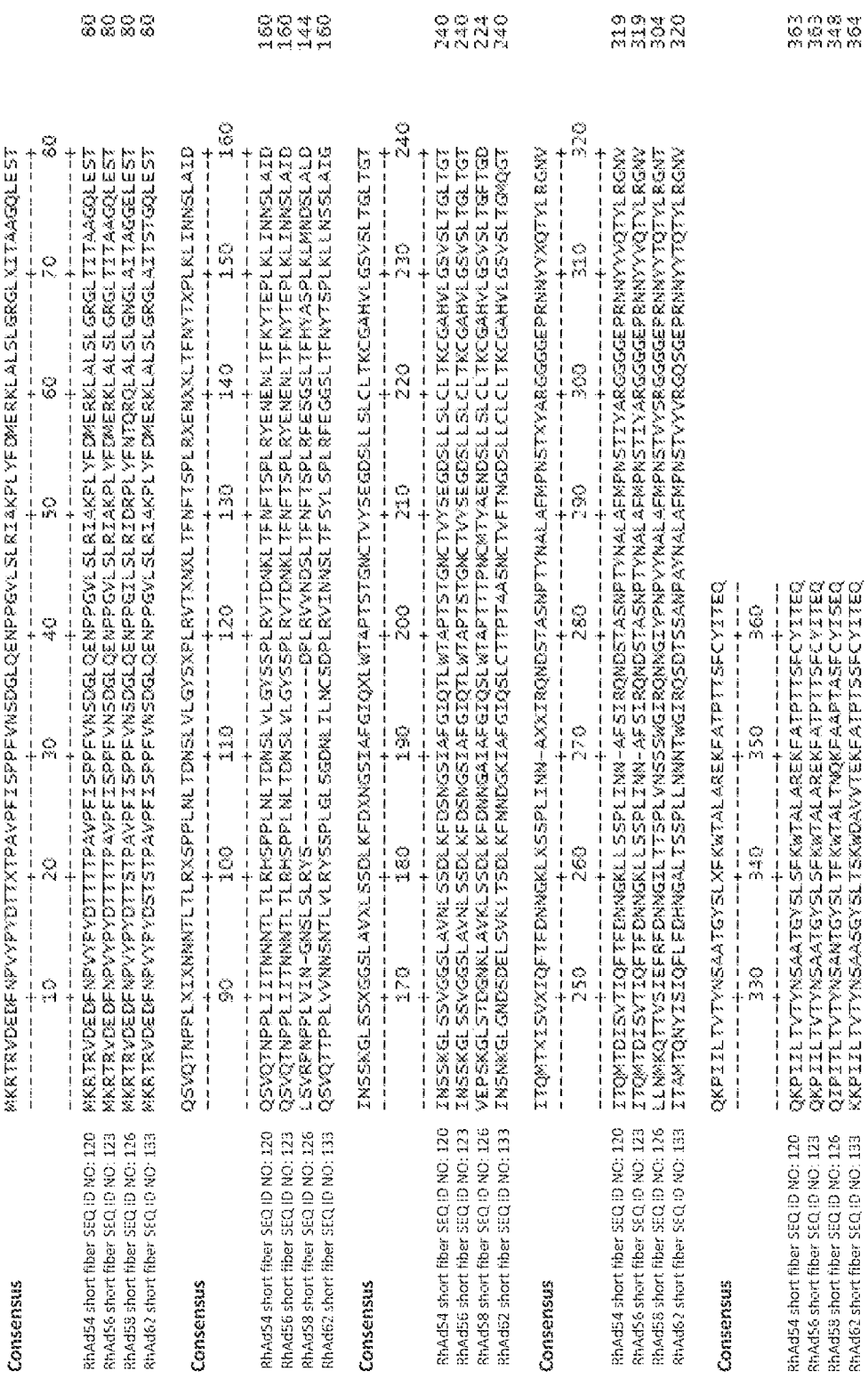
FIG. 50 is an image depicting an alignment of the polypeptide sequences of the short fiber proteins of RhAd54, RhAd56, RhAd58, and RhAd62, which correspond to SEQ ID NOs: 120, 123, 126, and 133, respectively. A consensus sequence corresponding to the alignment of the short fiber proteins of RhAd54, RhAd56, RhAd58, and RhAd62 is also provided (SEQ ID NO: 268).
Figure 51A:
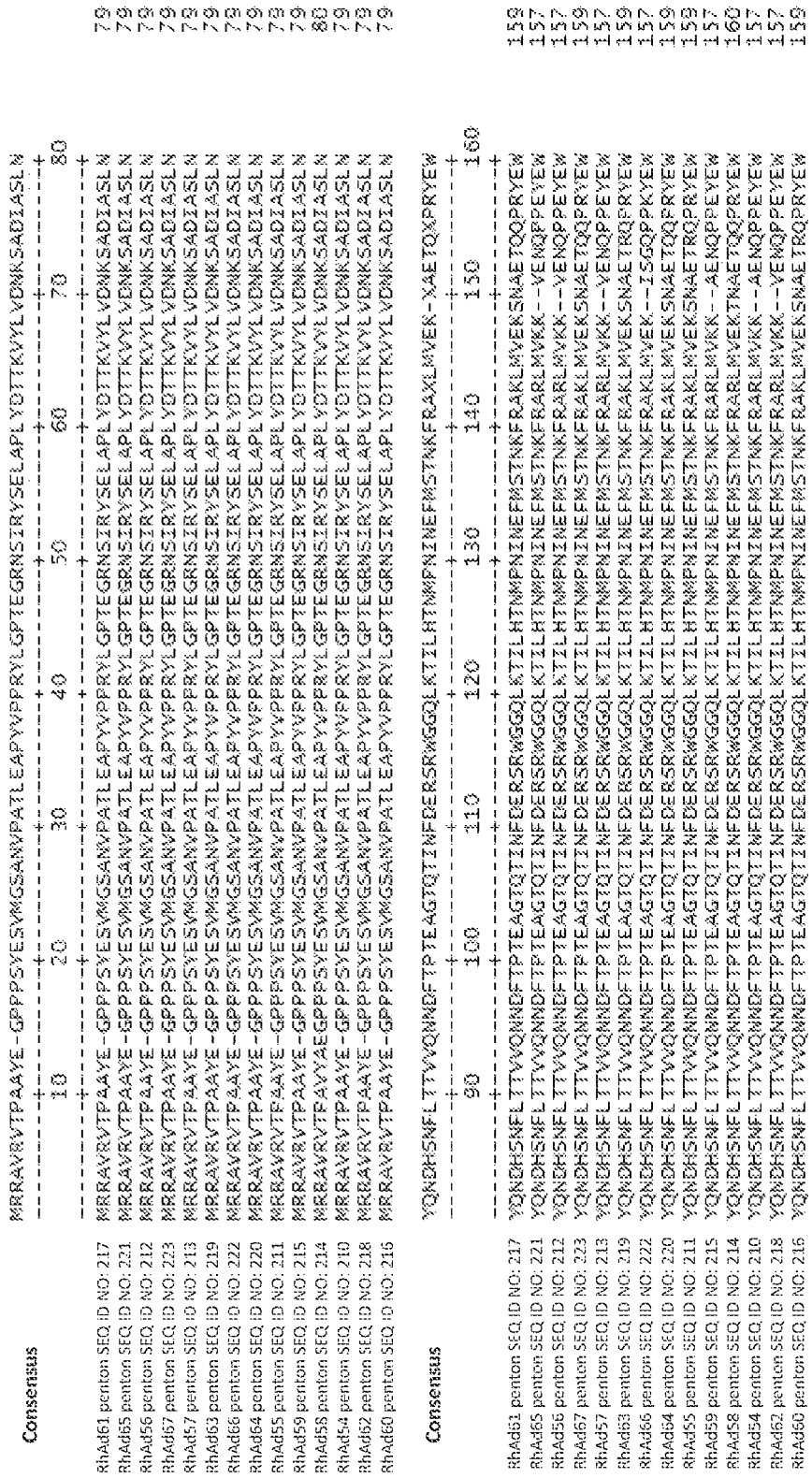
FIGS. 51A-D are a series of images depicting an alignment of the polypeptide sequences of the penton proteins of RhAd54-RhAd67, which correspond to SEQ ID NOs: 210-223, respectively. A consensus sequence corresponding to the alignment of the penton proteins of RhAd54-RhAd67 is also provided (SEQ ID NO: 269).
Figure 51B:
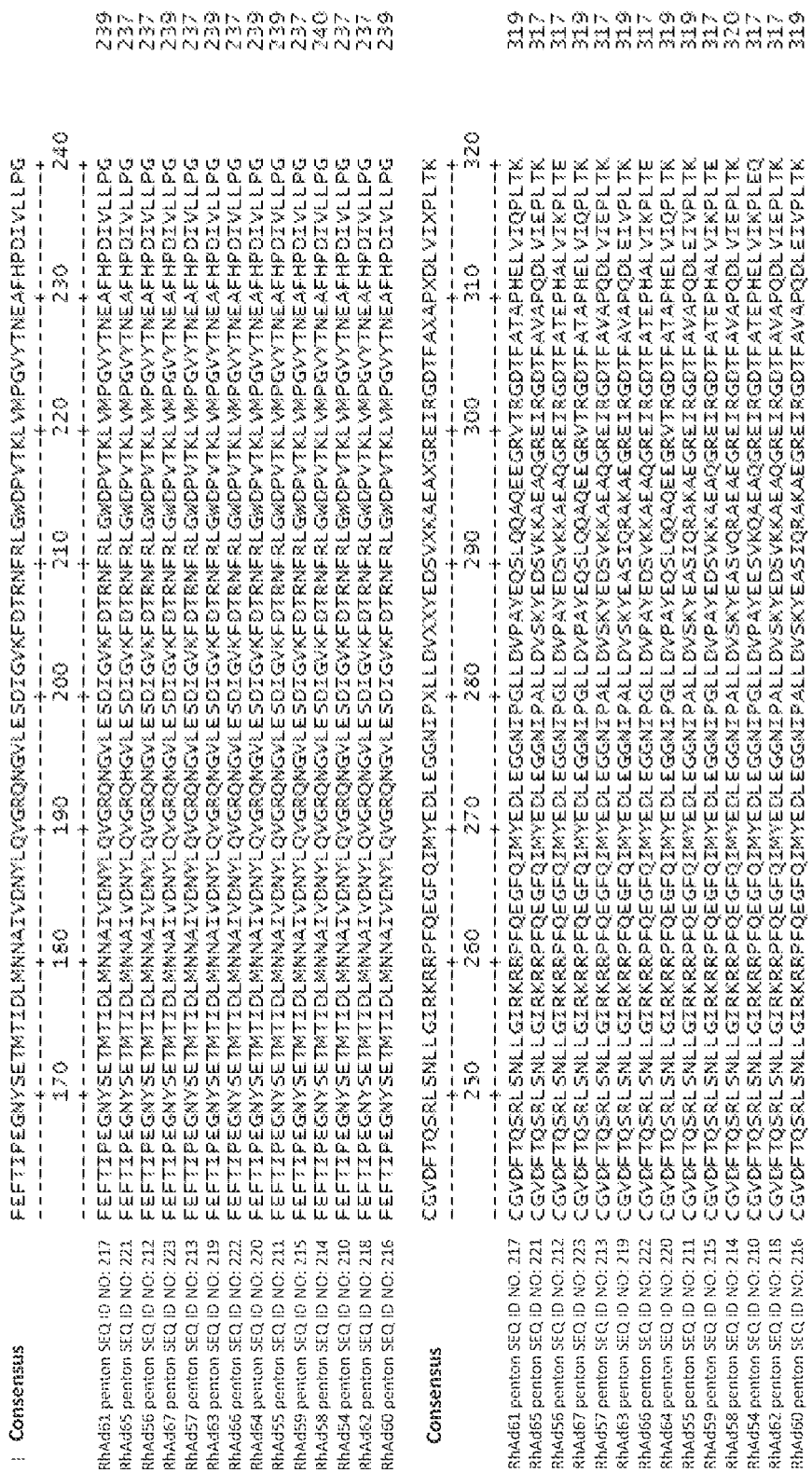
Figure 51C:
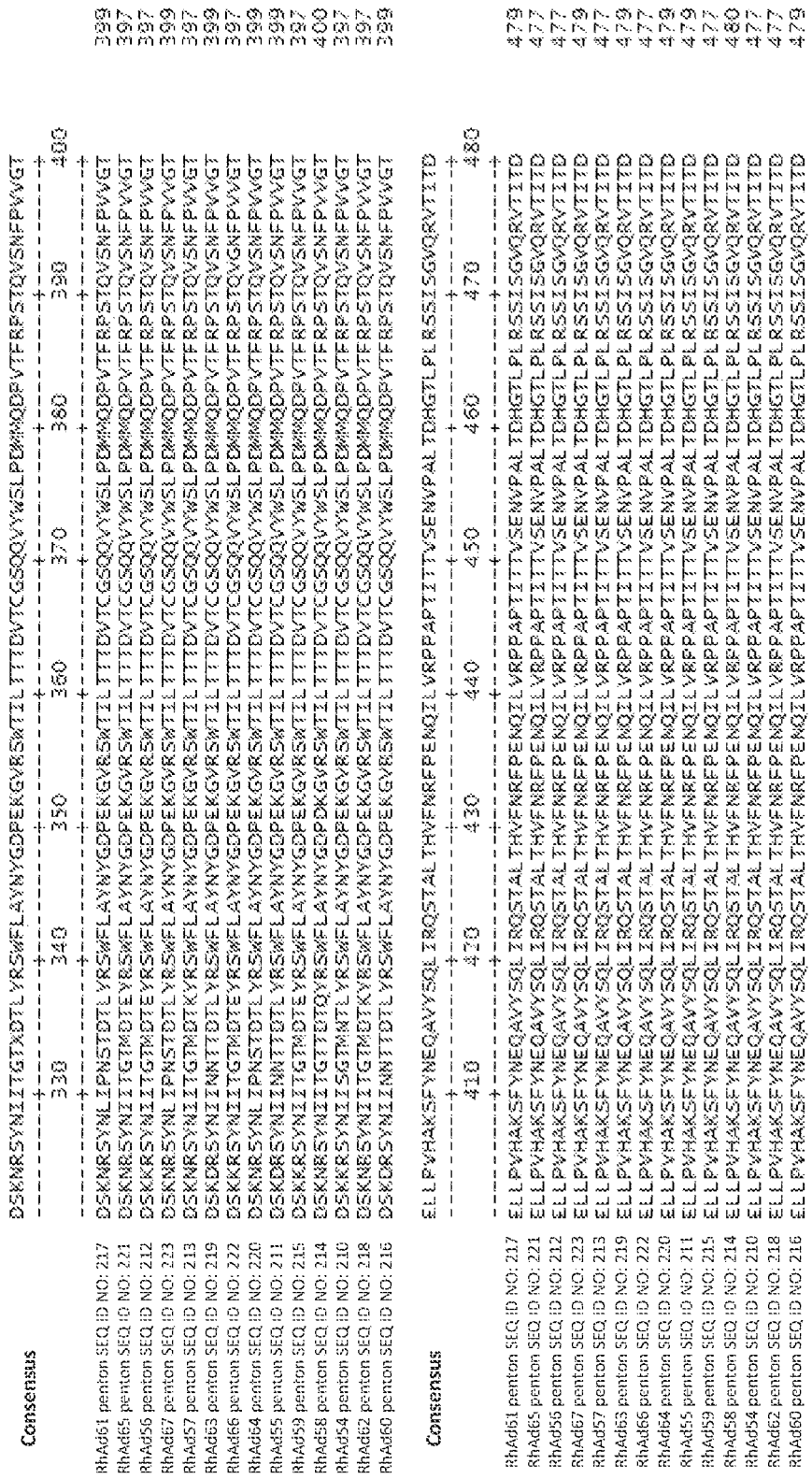
Figure 51D:
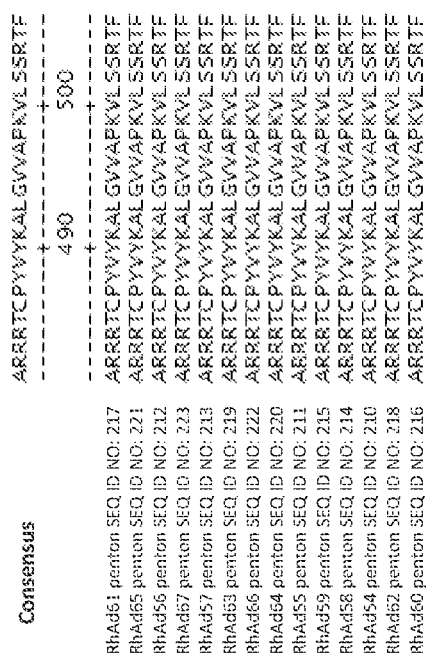

Also featured are short fiber proteins corresponding to the consensus sequence of SEQ ID NO: 268. As shown in FIG. 50, SEQ ID NO: 268 has been generated from the multiple sequence alignment of the short fiber proteins of RhAd54 (SEQ ID NO: 120), RhAd56 (SEQ ID NO: 123), RhAd58 (SEQ ID NO: 126), and RhAd62 (SEQ ID NO: 133). The consensus sequence shows regions of conservation and regions of variability. These regions of the consensus sequence can be used to identify amino acid mutations (e.g., additions, deletions, and substitutions) that can be incorporated into the short fiber proteins of SEQ ID NOs: 120-143 and variants thereof having 90% or more sequence identity (e.g., 91%, 92%, 93%, 94%, 95%, 96%, 97%, 98%, or 99% or more sequence identity). For example, the short fiber proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the short fiber proteins of SEQ ID NOs: 120-143 and variants thereof having 90% or more sequence identity.

The nucleotide sequence encoding the short fiber-1 protein can be at least 90% identical (e.g., at least 91%, 92%, 93%, or 94% identical), at least 95% identical (e.g., at least 96%, 97%, 98%, or 99% identical), or 100% identical to all or a portion of any one of SEQ ID NOs: 16, 17, 19, 20, 22, 23, 25, 27, 29, 30, 32, 34, 36, and 38, which corresponds to the nucleotide sequence encoding the short fiber-1 protein of RhAd54-RhAd67, respectively. The polypeptide sequences of the short fiber-1 protein of RhAd54-RhAd67 correspond to SEQ ID NOs: 120, 121, 123, 124, 126, 127, 129, 131, 133, 134, 136, 138, 140, and 142, respectively. Also featured are short fiber-1 polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of SEQ ID NOs: 120, 121, 123, 124, 126, 127, 129, 131, 133, 134, 136, 138, 140, and 142.

Figure 47A:
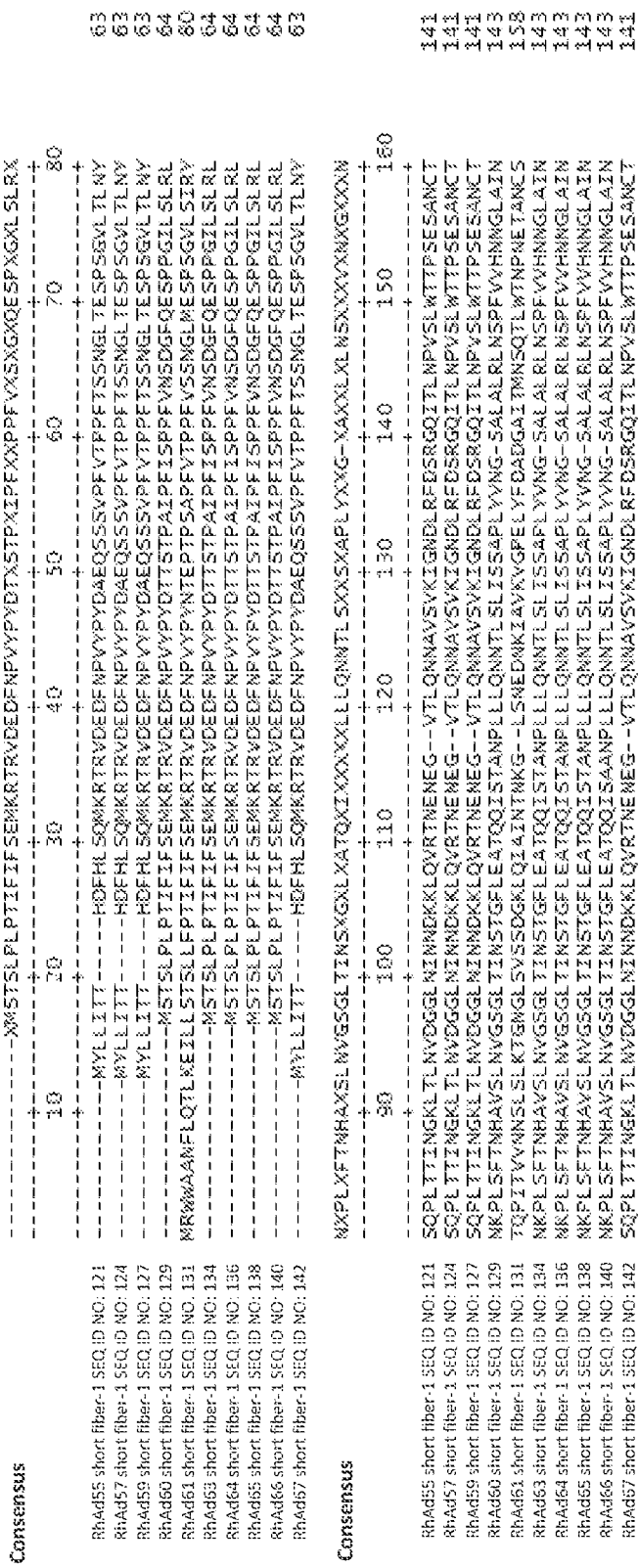
Figure 47B:
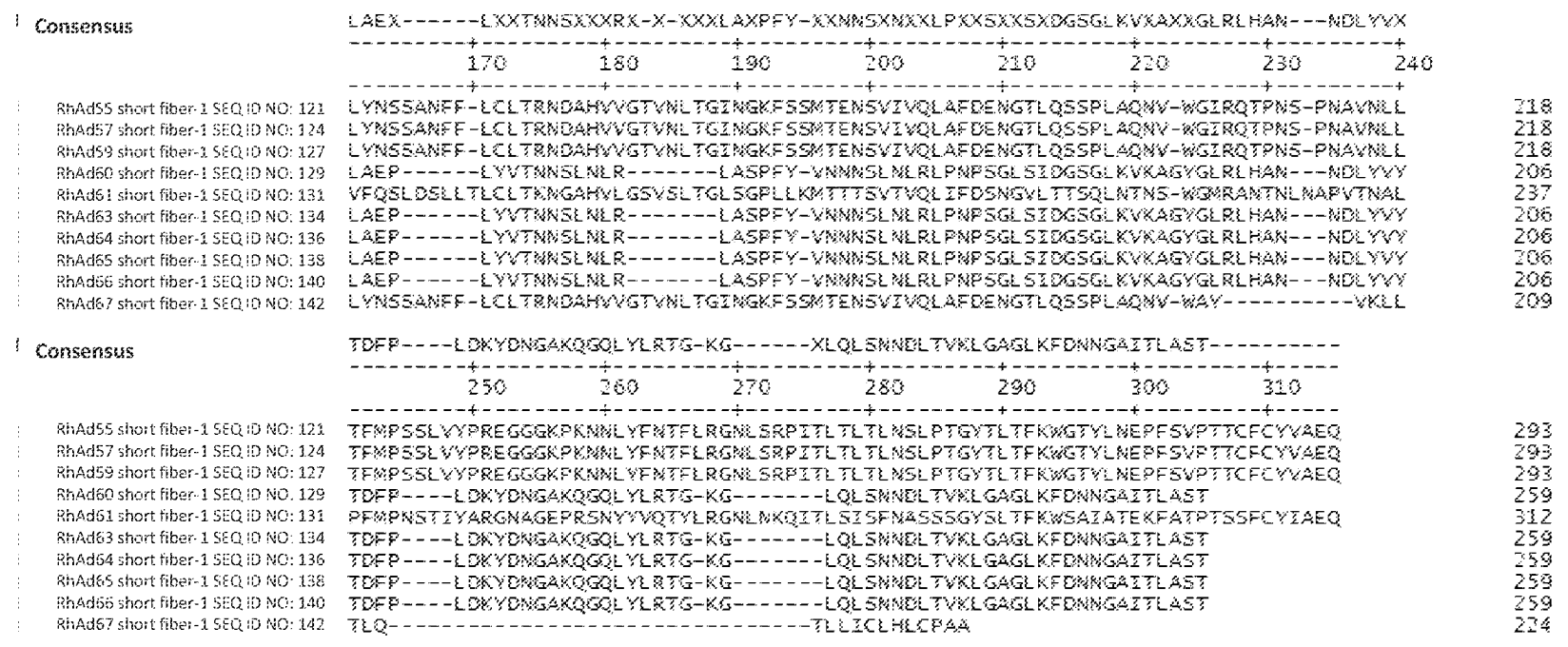

Also featured are short fiber-1 proteins corresponding to the consensus sequence of SEQ ID NO: 265. As shown in FIGS. 47A-47B, SEQ ID NO: 265 has been generated from the multiple sequence alignment of the short fiber-1 proteins of RhAd55 (SEQ ID NO: 121), RhAd57 (SEQ ID NO: 124), RhAd59 (SEQ ID NO: 127), RhAd60 (SEQ ID NO: 129), RhAd61 (SEQ ID NO: 131), RhAd63 (SEQ ID NO: 134), RhAd64 (SEQ ID NO: 136), RhAd65 (SEQ ID NO: 138), RhAD66 (SEQ ID NO: 140), and RhAd67 (SEQ ID NO: 142). The consensus sequence shows regions of conservation and regions of variability. These regions of the consensus sequence can be used to identify amino acid mutations (e.g., additions, deletions, and substitutions) that can be incorporated into the short fiber-1 proteins of SEQ ID NOs: 121, 124, 126, 127, 129, 131, 133, 134, 136, 138, 140, and 142 and variants thereof having 90% or more sequence identity (e.g., 91%, 92%, 93%, 94%, 95%, 96%, 97%, 98%, or 99% or more sequence identity). For example, the short fiber-1 proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the short fiber-1 proteins of SEQ ID NOs: 121, 124, 126, 127, 129, 131, 133, 134, 136, 138, 140, and 142 and variants thereof having 90% or more sequence identity.

The nucleotide sequence encoding the short fiber-2 protein can be at least 90% identical (e.g., at least 91%, 92%, 93%, or 94% identical), at least 95% identical (e.g., at least 96%, 97%, 98%, or 99% identical), or 100% identical to all or a portion of any one of SEQ ID NOs: 18, 21, 24, 26, 28, 31, 33, 35, 37, and 39, which corresponds to the nucleotide sequence encoding the short fiber-2 protein of RhAd55, RhAd57, RhAd59, RhAd60, RhAd61 and RhAd63-RhAd67, respectively. The polypeptide sequences of the short fiber-2 protein of RhAd54-RhAd67 correspond to SEQ ID NOs: 122, 125, 128, 130, 132, 135, 137, 139, 141, and 143, respectively. Also featured are short fiber-2 polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of SEQ ID NOs: 122, 125, 128, 130, 132, 135, 137, 139, 141, and 143.

Figure 48A:
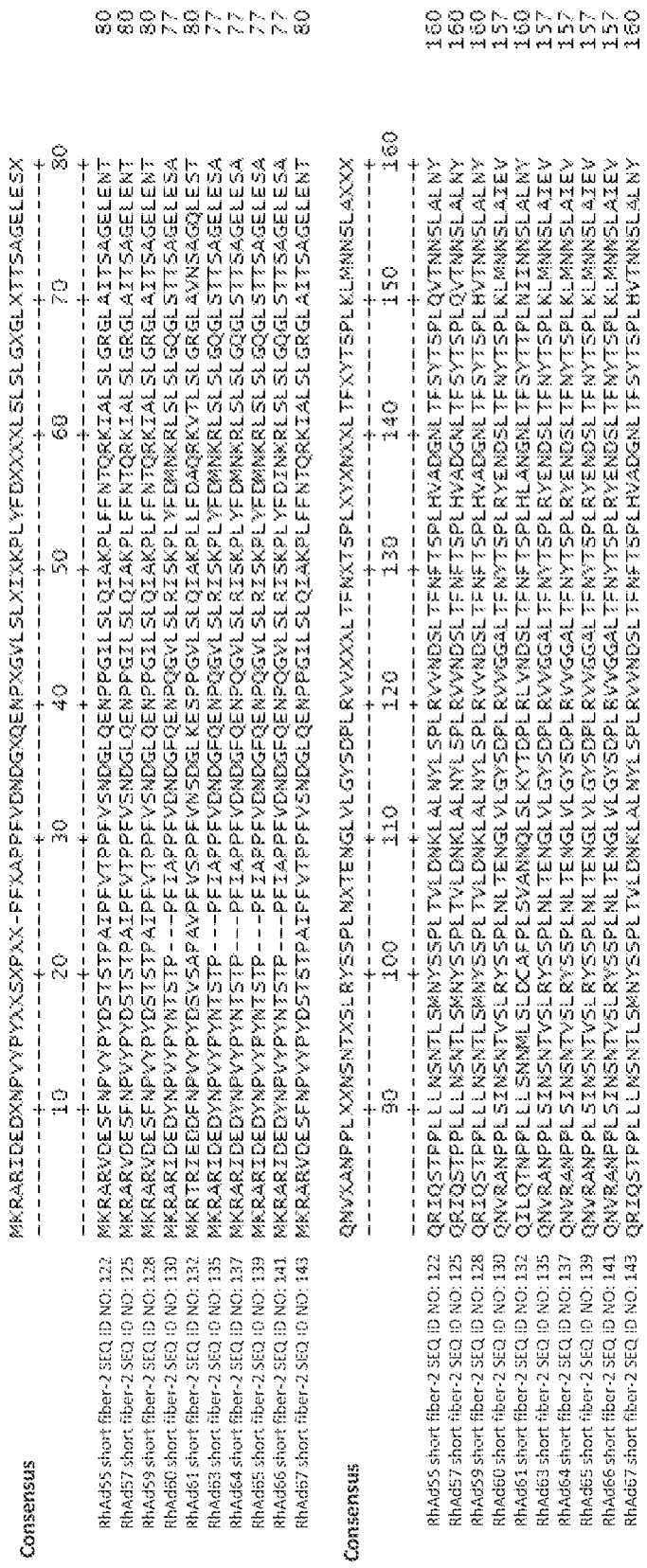
FIGS. 48A-48C are a series of images depicting an alignment of the polypeptide sequences of the short fiber-2 proteins of RhAd55, RhAd57, RhAd59-61, and RhAd63-67, which correspond to SEQ ID NOs: 122, 125, 128, 130, 132, 135, 137, 139, 141, and 143, respectively. A consensus sequence corresponding to the alignment of the short fiber-2 proteins of RhAd55, RhAd57, RhAd59-61, and RhAd63-67 is also provided (SEQ ID NO: 266).
Figure 48B:
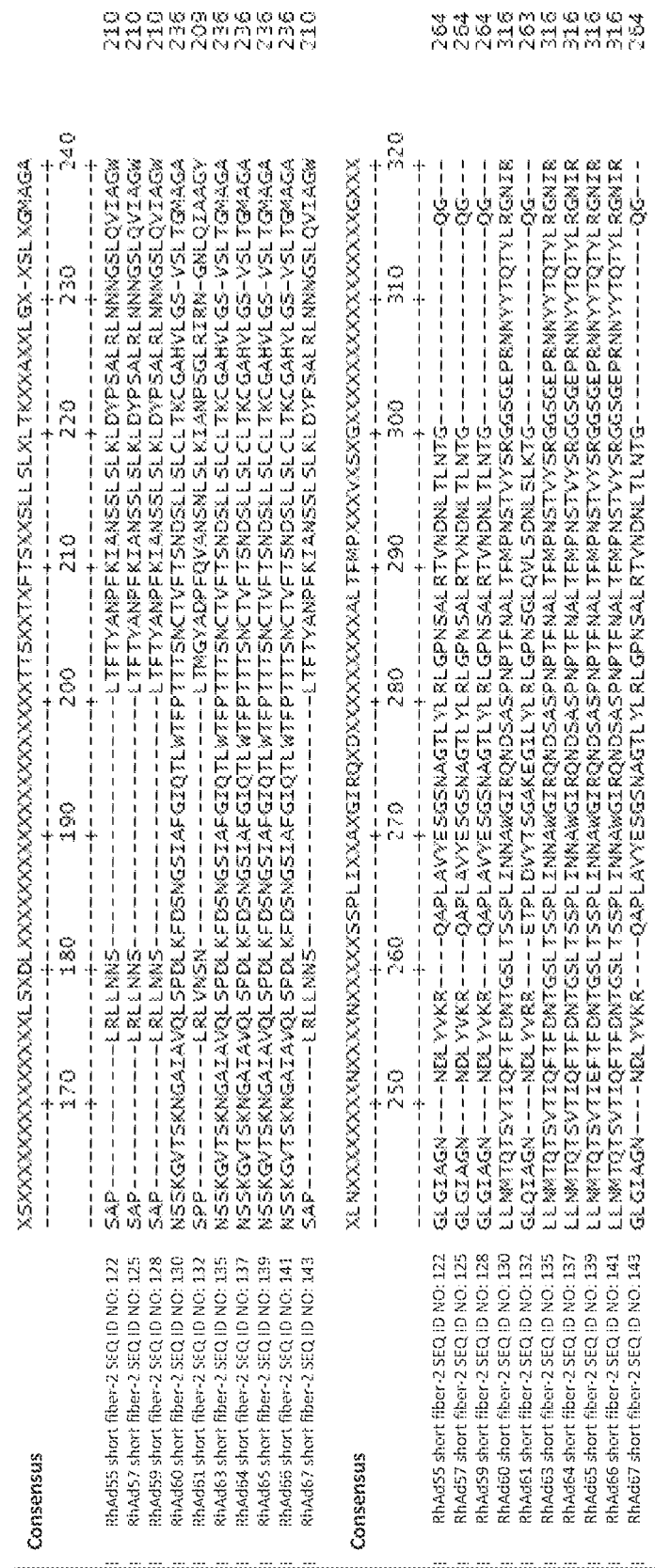
Figure 48C:
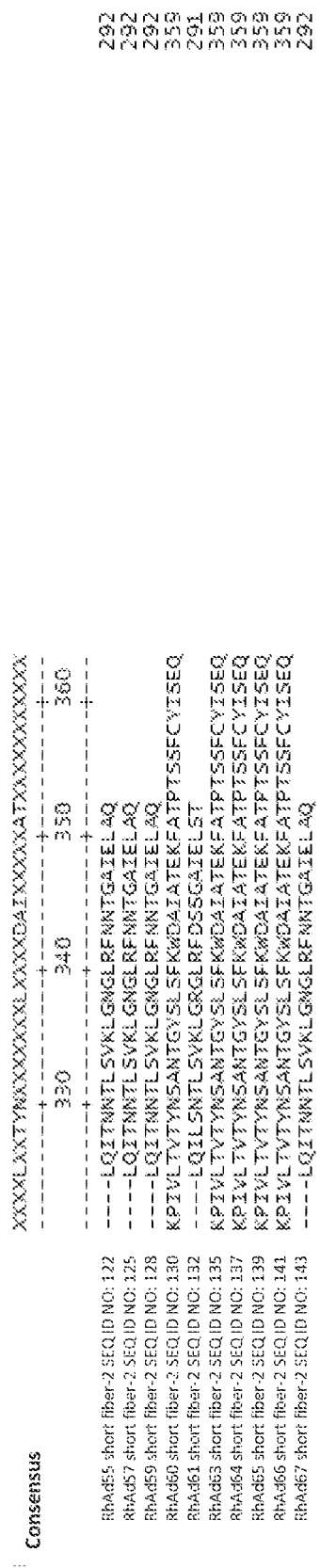

Also featured are short fiber-2 proteins corresponding to the consensus sequence of SEQ ID NO: 266. As shown in FIGS. 48A-48C, SEQ ID NO: 266 has been generated from the multiple sequence alignment of the short fiber-2 proteins of RhAd55 (SEQ ID NO: 122), RhAd57 (SEQ ID NO: 125), RhAd59 (SEQ ID NO: 128), RhAd60 (SEQ ID NO: 130), RhAd61 (SEQ ID NO: 132), RhAd63 (SEQ ID NO: 135), RhAd64 (SEQ ID NO: 137), RhAd65 (SEQ ID NO: 139), RhAD66 (SEQ ID NO: 141), and RhAd67 (SEQ ID NO: 143). The consensus sequence shows regions of conservation and regions of variability. These regions of the consensus sequence can be used to identify amino acid mutations (e.g., additions, deletions, and substitutions) that can be incorporated into the short fiber-2 proteins of SEQ ID NOs: 122, 125, 128, 130, 132, 135, 137, 139, 141, and 143 and variants thereof having 90% or more sequence identity (e.g., 91%, 92%, 93%, 94%, 95%, 96%, 97%, 98%, or 99% or more sequence identity). For example, the short fiber-2 proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the short fiber-2 proteins of SEQ ID NOs: 122, 125, 128, 130, 132, 135, 137, 139, 141, and 143 and variants thereof having 90% or more sequence identity.

The nucleotide sequence encoding the long fiber protein can be at least 90% identical (e.g., at least 91%, 92%, 93%, or 94% identical), at least 95% identical (e.g., at least 96%, 97%, 98%, or 99% identical), or 100% identical to all or a portion of any one of SEQ ID NOs: 40-53, which corresponds to the nucleotide sequence encoding the long fiber protein of RhAd54-RhAd67, respectively. The polypeptide sequences of the long fiber protein of RhAd54-RhAd67 correspond to SEQ ID NOs: 144-157, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of SEQ ID NOs: 144-157.

Also featured are long fiber proteins corresponding to the consensus sequence of SEQ ID NO: 264. As shown in FIGS. 46A-46D, SEQ ID NO: 264 has been generated from the multiple sequence alignment of the long fiber proteins of RhAd54 (SEQ ID NO: 144), RhAd55 (SEQ ID NO: 145), RhAd56 (SEQ ID NO: 146), RhAd57 (SEQ ID NO: 147), RhAd58 (SEQ ID NO: 148), RhAd59 (SEQ ID NO: 149), RhAd60 (SEQ ID NO: 150), RhAd61 (SEQ ID NO: 151), RhAD62 (SEQ ID NO: 152), RhAd63 (SEQ ID NO: 153), RhAd64 (SEQ ID NO: 154), RhAd65 (SEQ ID NO: 155), RhAd66 (SEQ ID NO: 156), and RhAd67 (SEQ ID NO: 157). The consensus sequence shows regions of conservation and regions of variability. These regions of the consensus sequence can be used to identify amino acid mutations (e.g., additions, deletions, and substitutions) that can be incorporated into the long fiber proteins of SEQ ID NOs: 144-157 and variants thereof having 90% or more sequence identity (e.g., 91%, 92%, 93%, 94%, 95%, 96%, 97%, 98%, or 99% or more sequence identity). For example, the long fiber proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the long fiber proteins of SEQ ID NOs: 144-157 and variants thereof having 90% or more sequence identity.

Figure 49A:
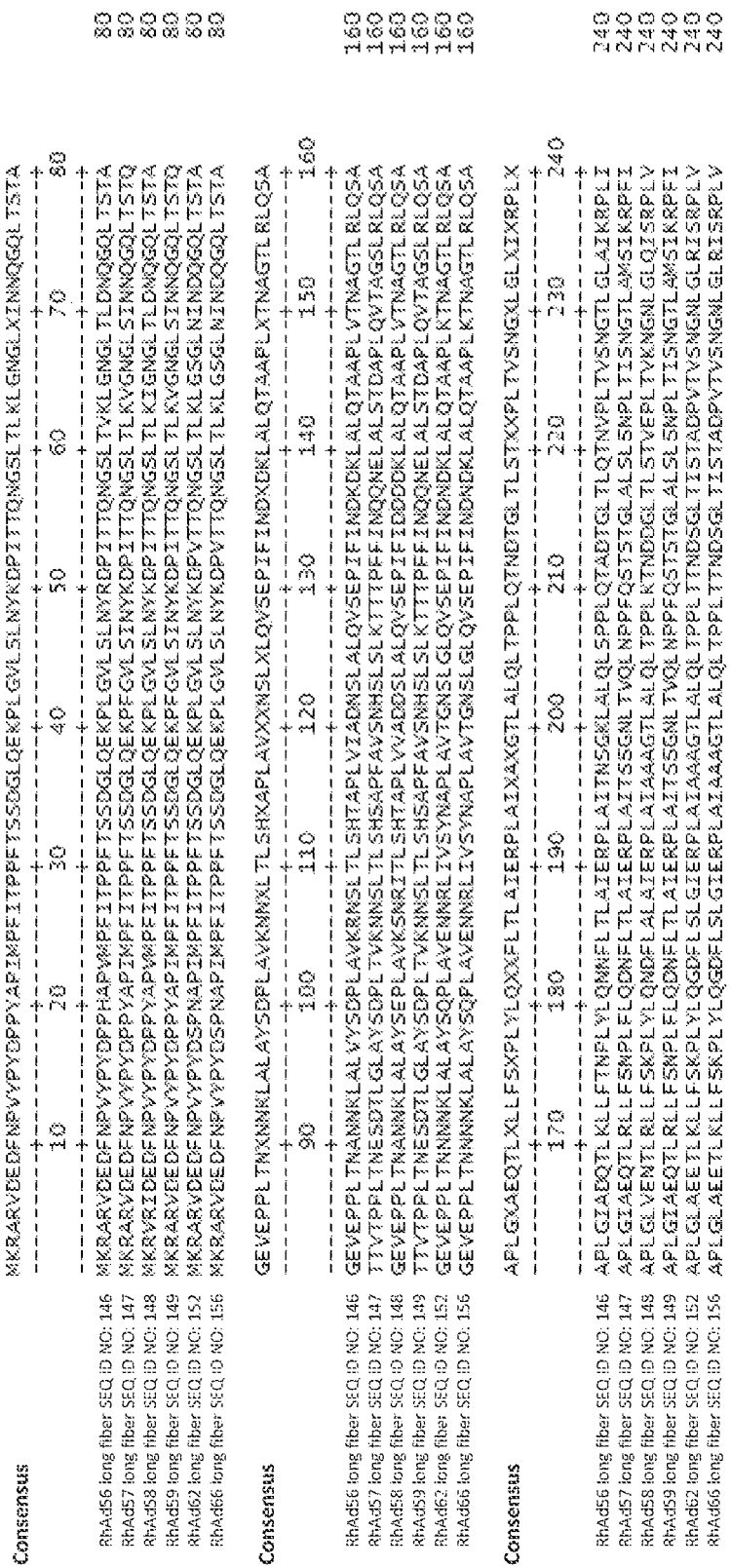

Also featured are long fiber proteins corresponding to the consensus sequence of SEQ ID NO: 267. As shown in FIGS. 49A-49B, SEQ ID NO: 267 has been generated from the multiple sequence alignment of the long fiber proteins of RhAd56 (SEQ ID NO: 146), RhAd57 (SEQ ID NO: 147), RhAd58 (SEQ ID NO: 148), RhAd59 (SEQ ID NO: 149), RhAD62 (SEQ ID NO: 152), and RhAd66 (SEQ ID NO: 156). The consensus sequence shows regions of conservation and regions of variability. These regions of the consensus sequence can be used to identify amino acid mutations (e.g., additions, deletions, and substitutions) that can be incorporated into the long fiber proteins of SEQ ID NOs: 144-157 and variants thereof having 90% or more sequence identity (e.g., 91%, 92%, 93%, 94%, 95%, 96%, 97%, 98%, or 99% or more sequence identity). For example, the long fiber proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the long fiber proteins of SEQ ID NOs: 144-157 and variants thereof having 90% or more sequence identity.

The nucleotide sequence encoding the hexon protein can be at least 90% identical (e.g., at least 91%, 92%, 93%, or 94% identical), at least 95% identical (e.g., at least 96%, 97%, 98%, or 99% identical), or 100% identical to all or a portion of any one of SEQ ID NOs: 54-67, which corresponds to the nucleotide sequence encoding the hexon protein of RhAd54-RhAd67, respectively. The polypeptide sequences of the hexon protein of RhAd54-RhAd67 correspond to SEQ ID NOs: 158-171, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of SEQ ID NOs: 158-171.

Also featured are hexon proteins corresponding to the consensus sequence of SEQ ID NO: 271. As shown in FIGS. 53A-53F, SEQ ID NO: 271 has been generated from the multiple sequence alignment of the hexon proteins of RhAd54 (SEQ ID NO: 158), RhAd55 (SEQ ID NO: 159), RhAd56 (SEQ ID NO: 160), RhAd57 (SEQ ID NO: 161), RhAd58 (SEQ ID NO: 162), RhAd59 (SEQ ID NO: 163), RhAd60 (SEQ ID NO: 164), RhAd61 (SEQ ID NO: 165), RhAD62 (SEQ ID NO: 166), RhAd63 (SEQ ID NO: 167), RhAd64 (SEQ ID NO: 168), RhAd65 (SEQ ID NO: 169), RhAd66 (SEQ ID NO: 170), and RhAd67 (SEQ ID NO: 171). The consensus sequence shows regions of conservation and regions of variability. These regions of the consensus sequence can be used to identify amino acid mutations (e.g., additions, deletions, and substitutions) that can be incorporated into the hexon proteins of SEQ ID NOs: 158-171 and variants thereof having 90% or more sequence identity (e.g., 91%, 92%, 93%, 94%, 95%, 96%, 97%, 98%, or 99% or more sequence identity). For example, the hexon proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the hexon proteins of SEQ ID NOs: 158-171 and variants thereof having 90% or more sequence identity.

Figure 54A:
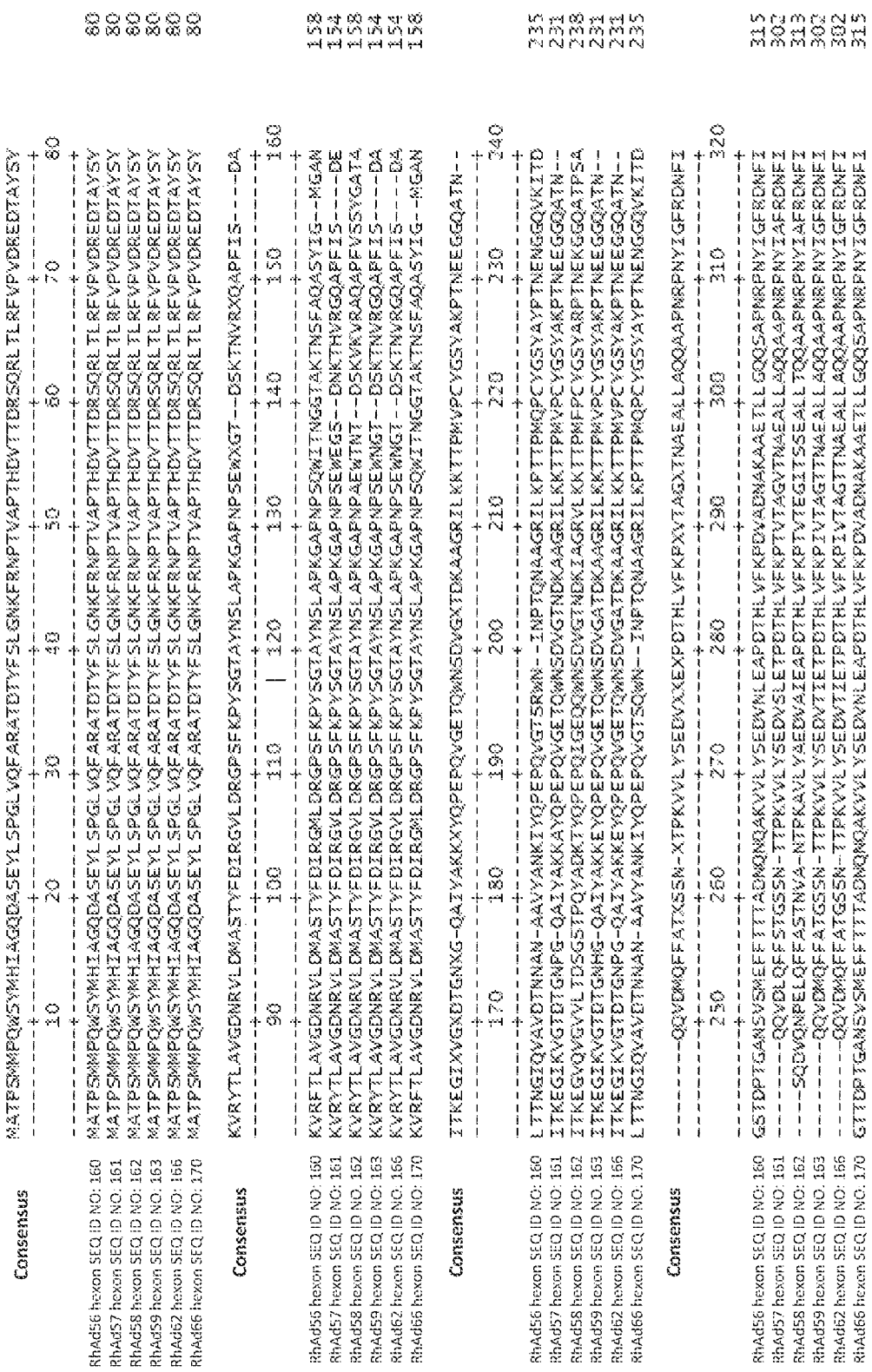
Figure 54B:
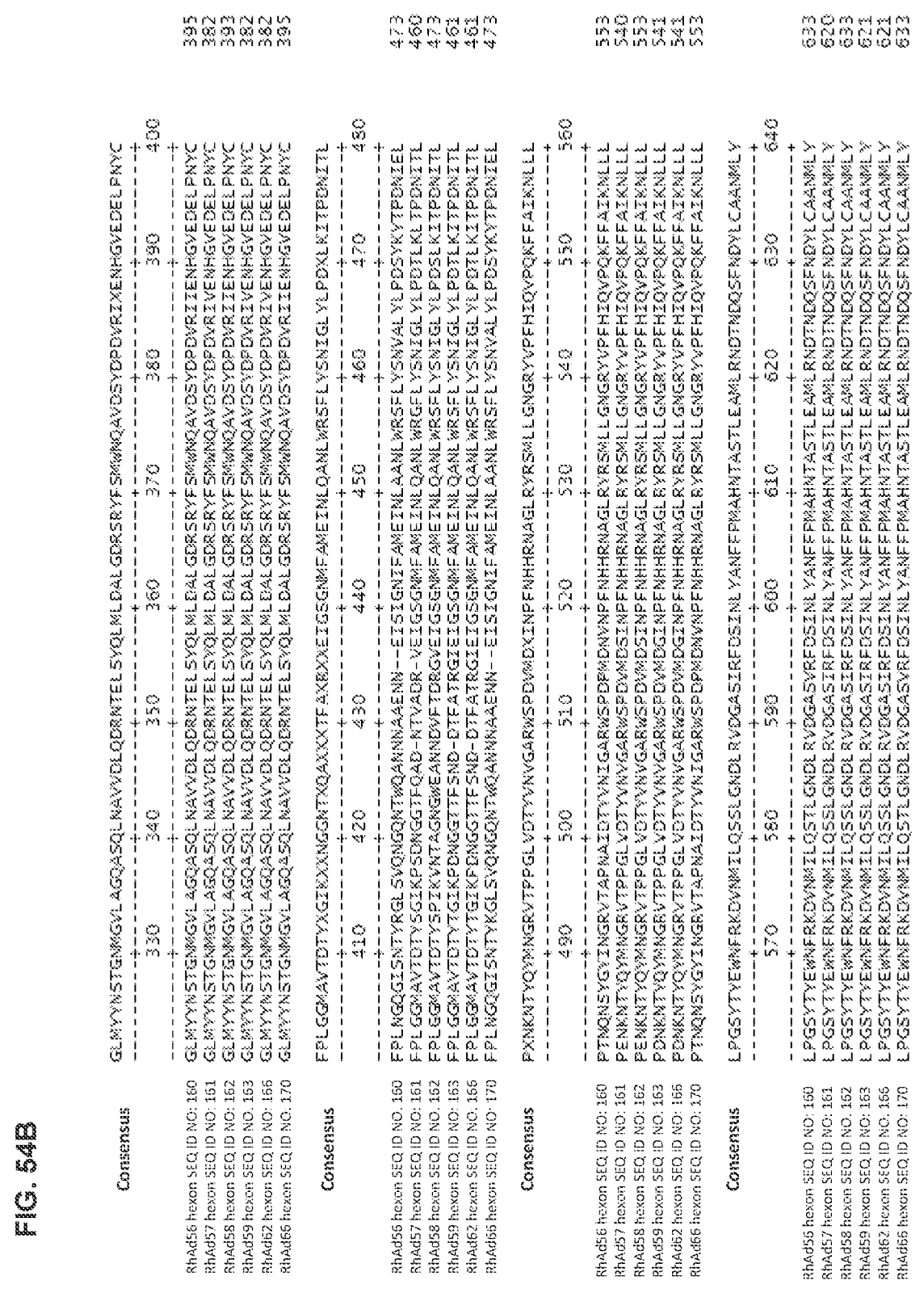
Figure 54C:
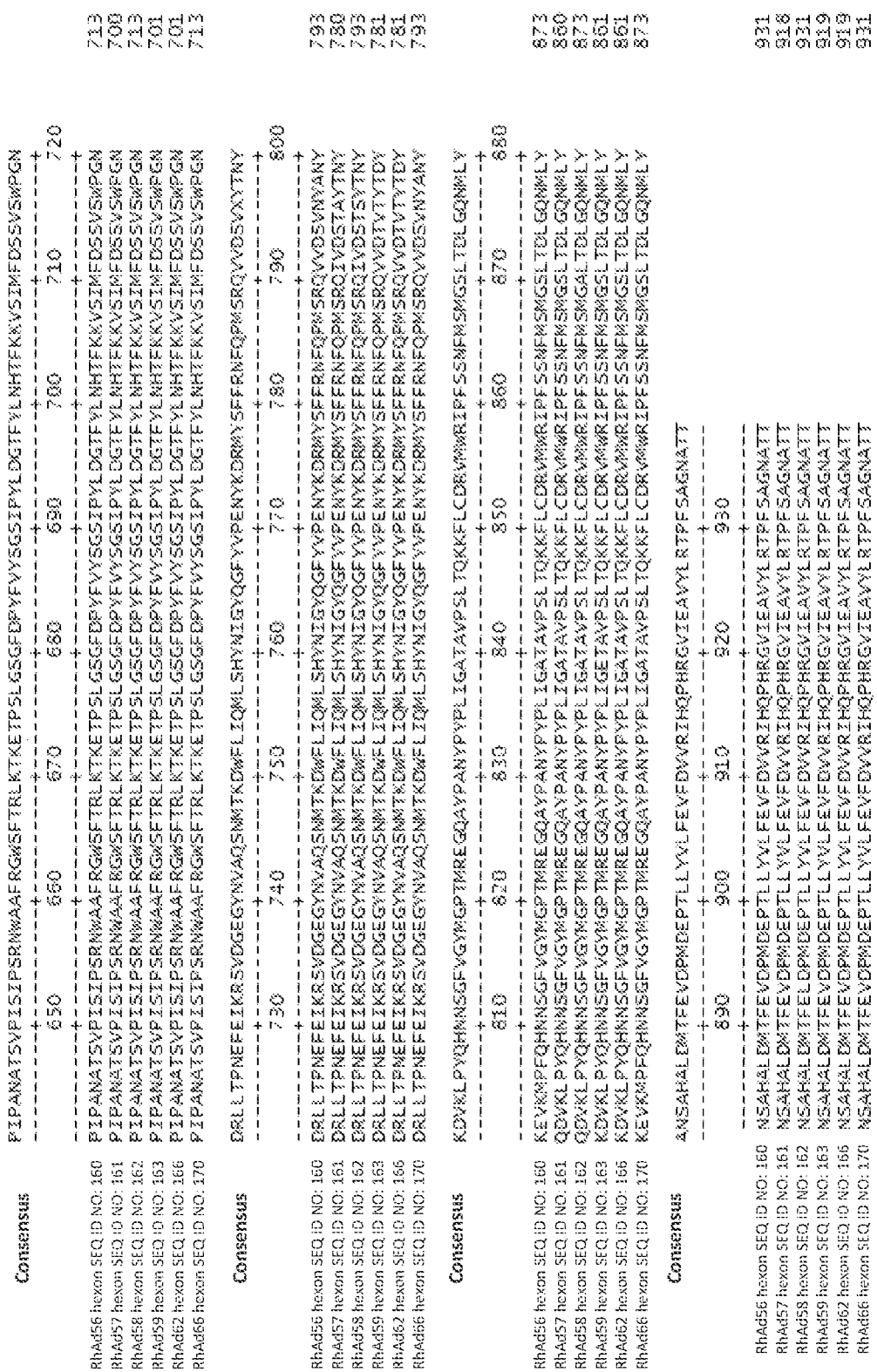

Also featured are hexon proteins corresponding to the consensus sequence of SEQ ID NO: 272. As shown in FIGS. 54A-54C, SEQ ID NO: 272 has been generated from the multiple sequence alignment of the hexon proteins of RhAd56 (SEQ ID NO: 160), RhAd57 (SEQ ID NO: 161), RhAd58 (SEQ ID NO: 162), RhAd59 (SEQ ID NO: 163), RhAD62 (SEQ ID NO: 166), and RhAd66 (SEQ ID NO: 170). The consensus sequence shows regions of conservation and regions of variability. These regions of the consensus sequence can be used to identify amino acid mutations (e.g., additions, deletions, and substitutions) that can be incorporated into the hexon proteins of SEQ ID NOs: 158-171 and variants thereof having 90% or more sequence identity (e.g., 91%, 92%, 93%, 94%, 95%, 96%, 97%, 98%, or 99% or more sequence identity). For example, the hexon proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the hexon proteins of SEQ ID NOs: 158-171 and variants thereof having 90% or more sequence identity.

In some instances, the nucleotide sequence can be at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of one or more hexon protein hypervariable regions (HVRs) of RhAd54-RhAd67 (e.g., a HVR delineated in Table 2 of a hexon protein of any one of RhAd54-RhAd67), respectively. The polypeptide sequences of the HVR of RhAd54-RhAd67 can be encoded by the nucleotide ranges delineated in Table 2 for the hexon protein of RhAd54-RhAd67, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of the amino acid sequences encoded by the HVRs delineated in Table 2 of a hexon protein of any one of RhAd54-RhAd67.

The nucleotide sequence encoding the penton protein can be at least 90% identical (e.g., at least 91%, 92%, 93%, or 94% identical), at least 95% identical (e.g., at least 96%, 97%, 98%, or 99% identical), or 100% identical to all or a portion of any one of SEQ ID NOs: 106-119, which corresponds to the nucleotide sequence encoding the penton protein of RhAd54-RhAd67, respectively. The polypeptide sequences of the penton protein of RhAd54-RhAd67 correspond to SEQ ID NOs: 210-223, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of SEQ ID NOs: 210-223. Also featured are penton proteins corresponding to the consensus sequence of SEQ ID NO: 269.

As shown in FIGS. 51A-51D, SEQ ID NO: 269 has been generated from the multiple sequence alignment of the penton proteins of RhAd54 (SEQ ID NO: 210), RhAd55 (SEQ ID NO: 211), RhAd56 (SEQ ID NO: 212), RhAd57 (SEQ ID NO: 213), RhAd58 (SEQ ID NO: 214), RhAd59 (SEQ ID NO: 215), RhAd60 (SEQ ID NO: 216), RhAd61 (SEQ ID NO: 217), RhAD62 (SEQ ID NO: 218), RhAd63 (SEQ ID NO: 219), RhAd64 (SEQ ID NO: 220), RhAd65 (SEQ ID NO: 221), RhAd66 (SEQ ID NO: 222), and RhAd67 (SEQ ID NO: 223). The consensus sequence shows regions of conservation and regions of variability. These regions of the consensus sequence can be used to identify amino acid mutations (e.g., additions, deletions, and substitutions) that can be incorporated into the penton proteins of SEQ ID NOs: 210-223 and variants thereof having 90% or more sequence identity (e.g., 91%, 92%, 93%, 94%, 95%, 96%, 97%, 98%, or 99% or more sequence identity). For example, the penton proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the penton proteins of SEQ ID NOs: 210-223 and variants thereof having 90% or more sequence identity.

Figure 52A:
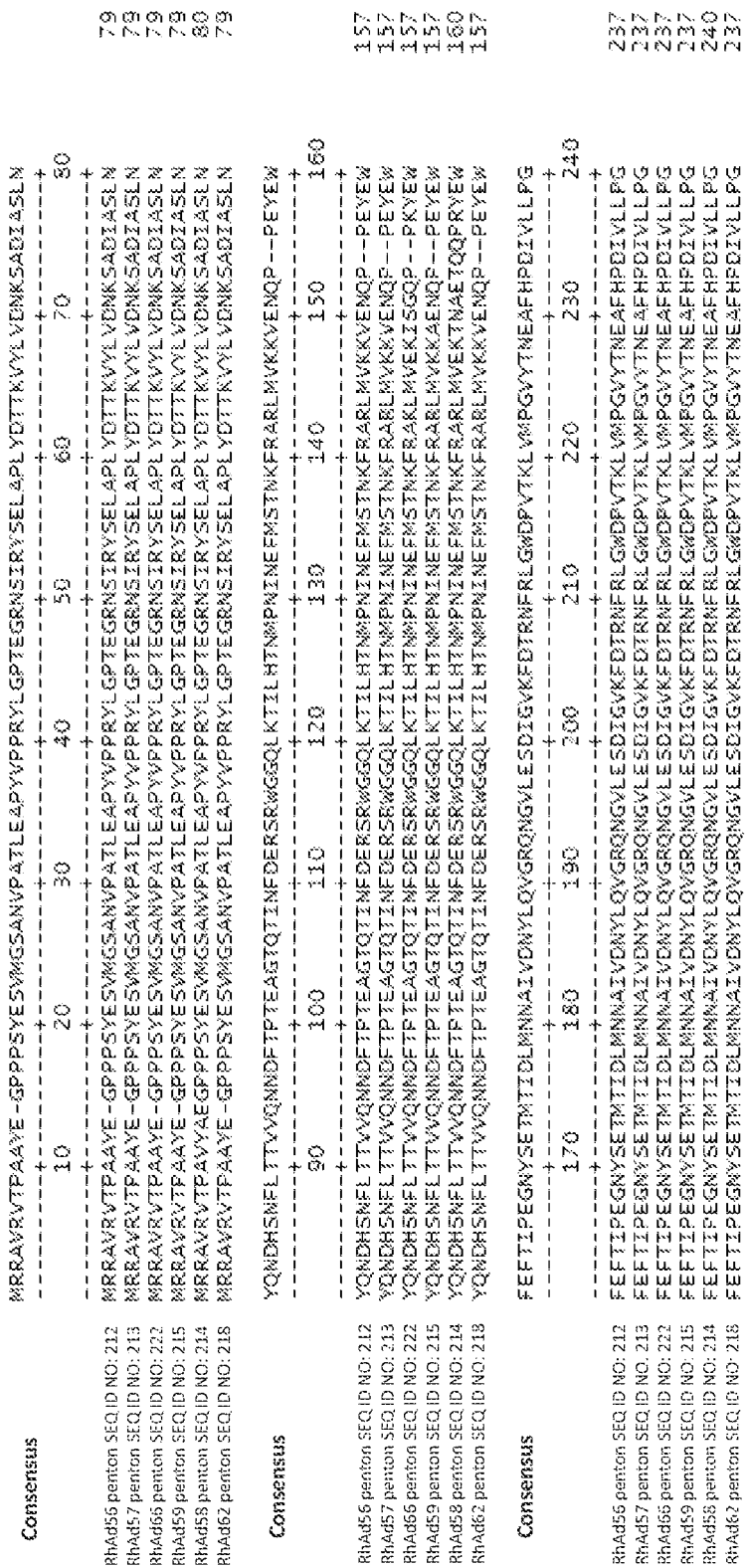
FIGS. 52A-52B are a series of images depicting an alignment of the polypeptide sequences of the penton proteins of RhAd56-59, RhAd62 and RhAd66, which correspond to SEQ ID NOs: 212-215, 218, and 222, respectively. A consensus sequence corresponding to the alignment of the penton proteins of RhAd56-59, RhAd62 and RhAd66 is also provided (SEQ ID NO: 270).
Figure 52B:
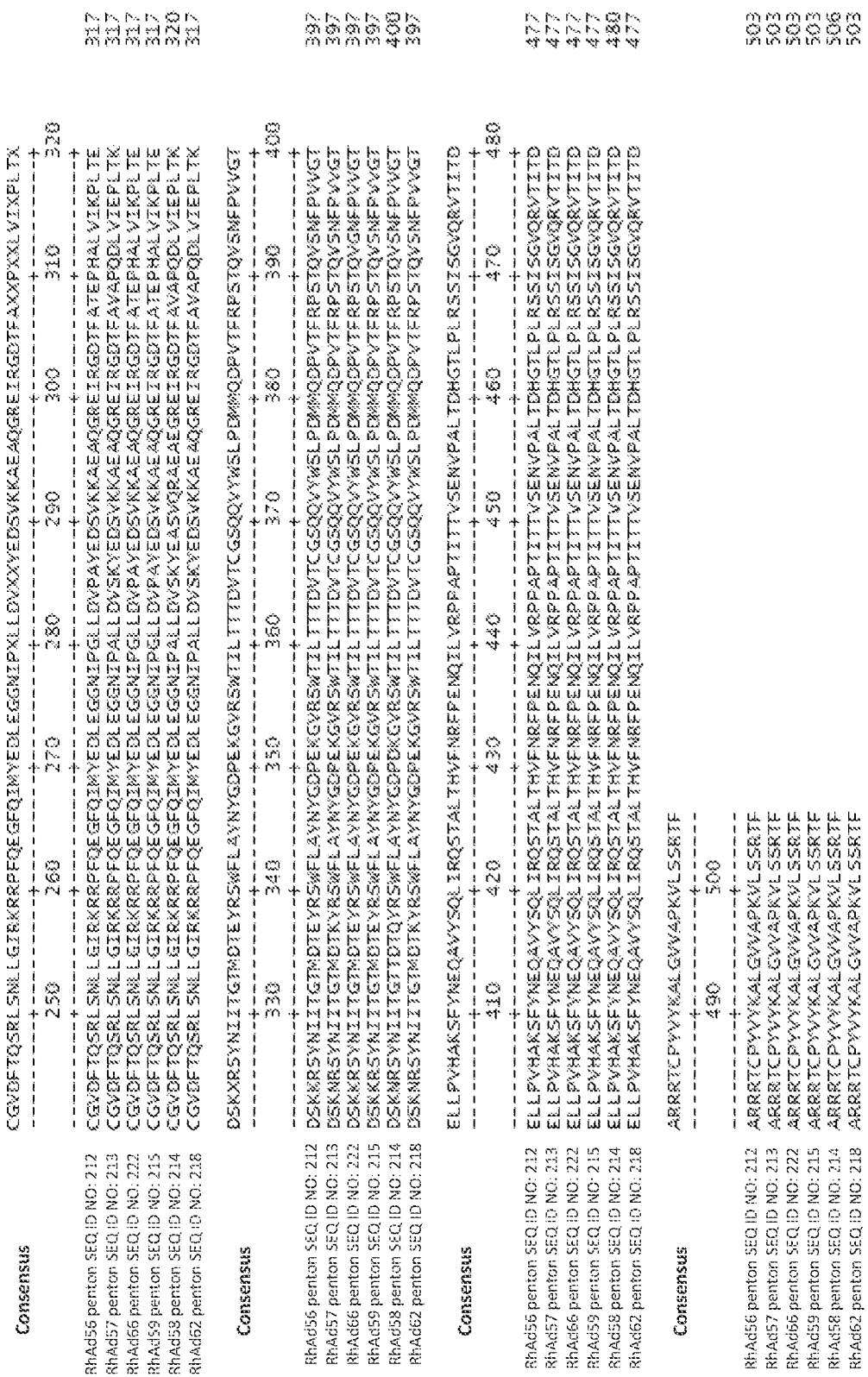
Figure 53A:
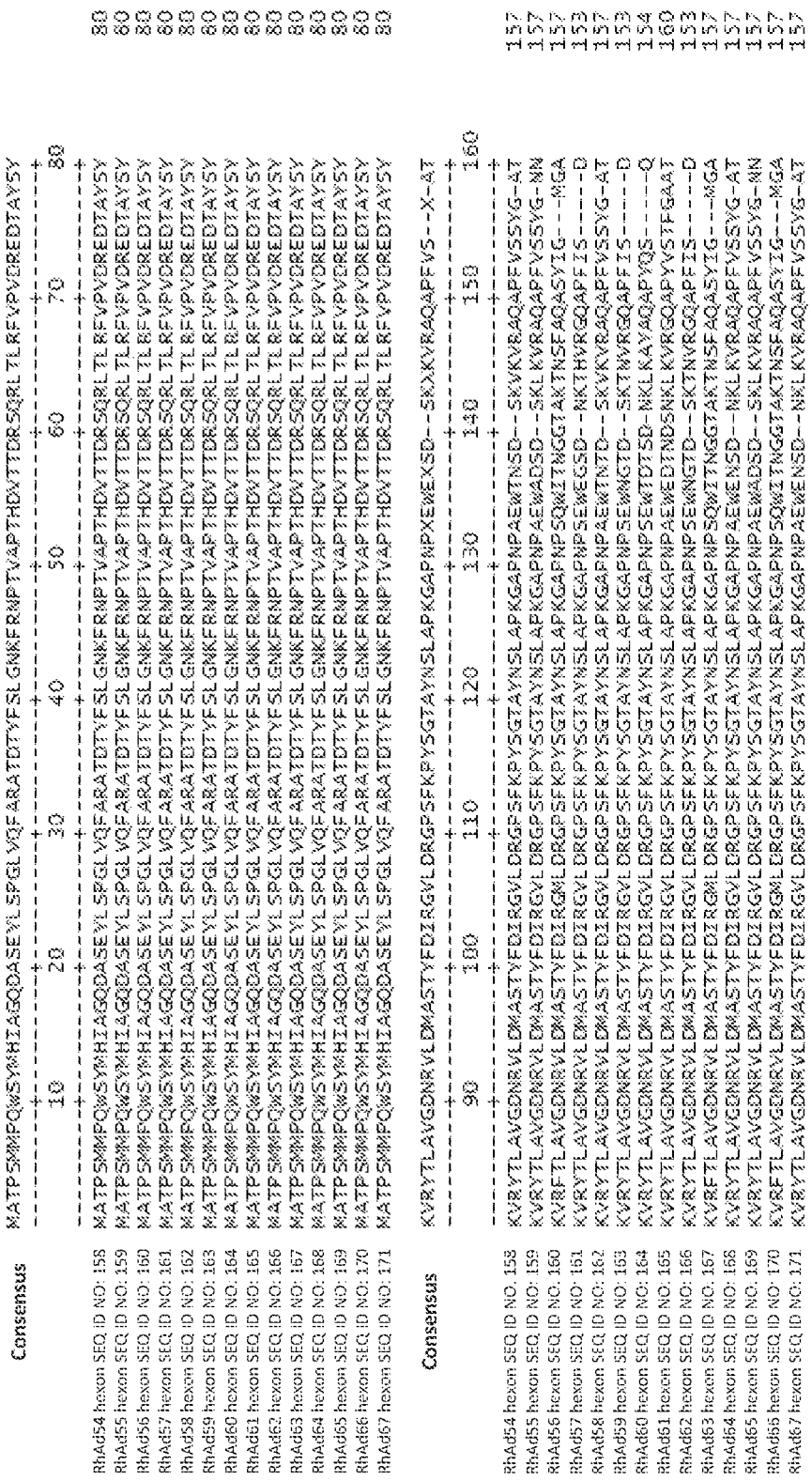
Figure 53B:
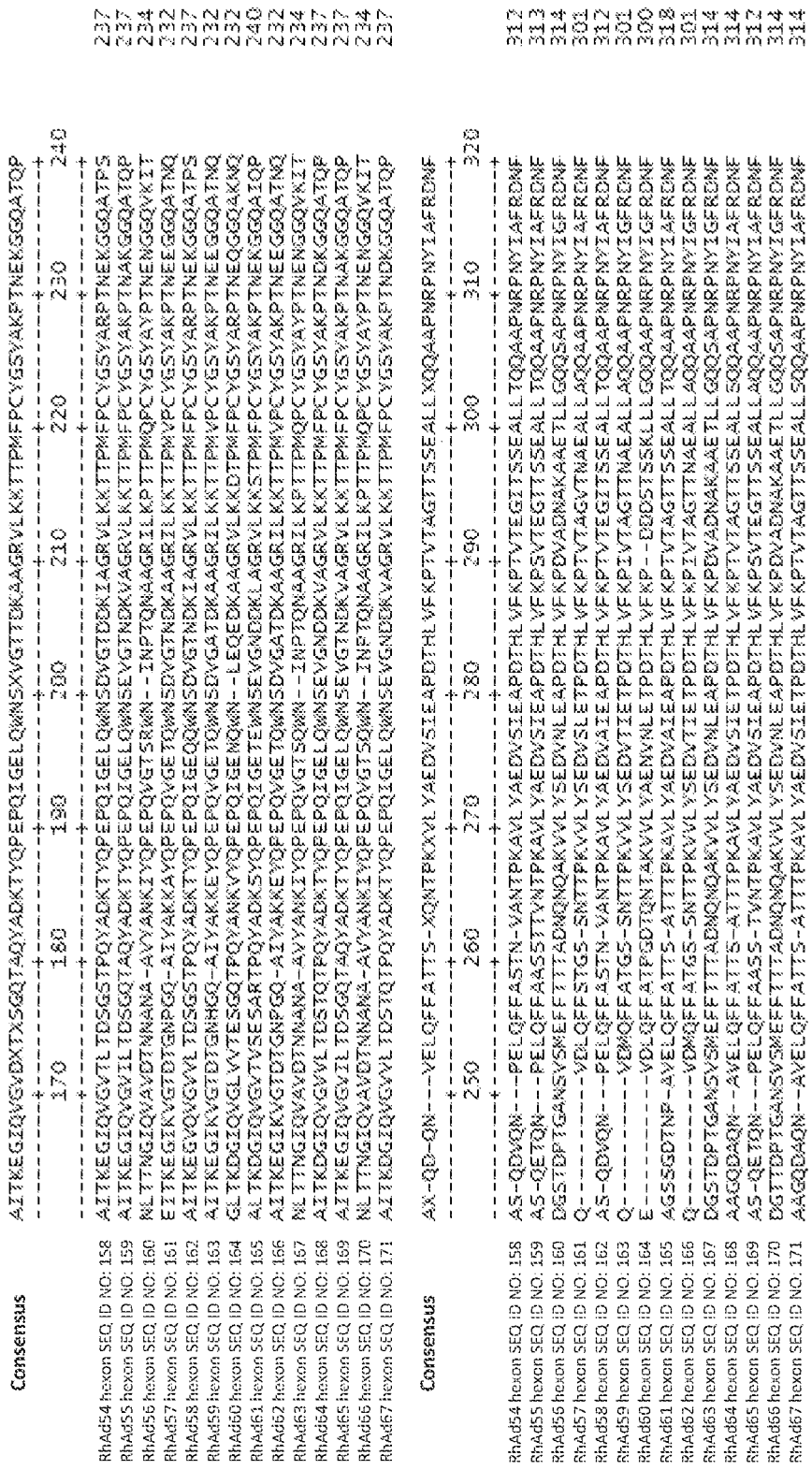
Figure 53D:
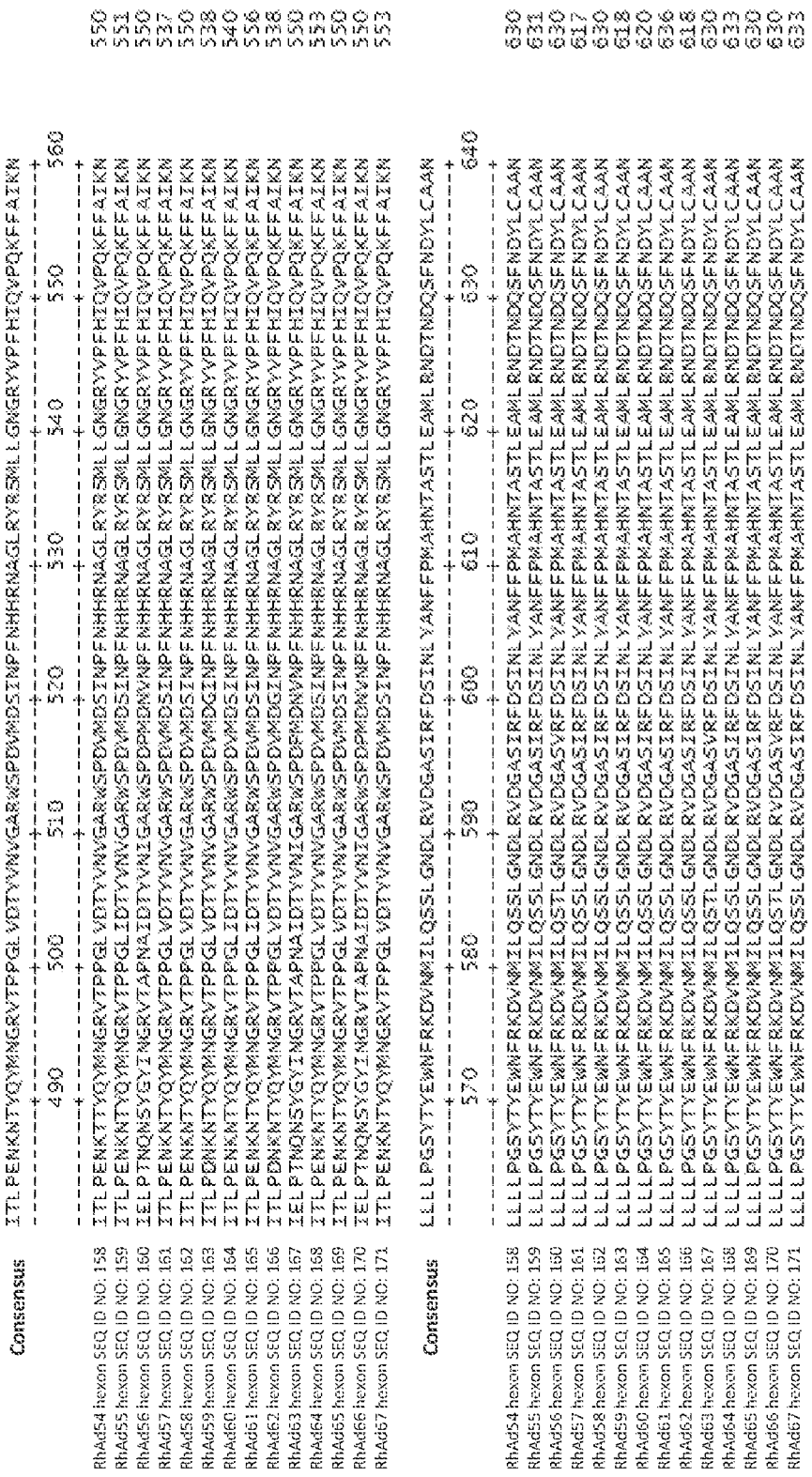
Figure 53E:
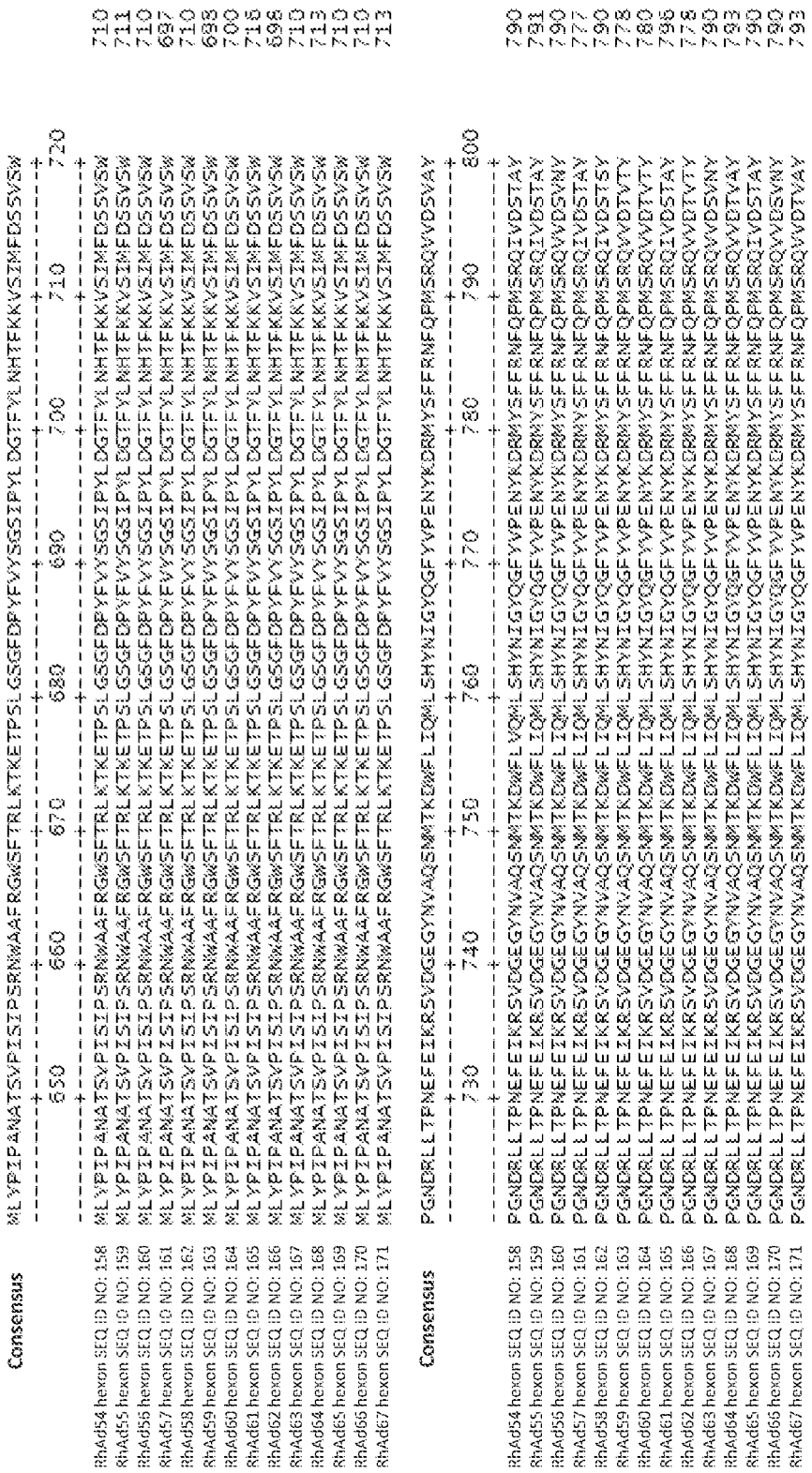

Also featured are penton proteins corresponding to the consensus sequence of SEQ ID NO: 270. As shown in FIGS. 52A-52B, SEQ ID NO: 270 has been generated from the multiple sequence alignment of the penton proteins of RhAd56 (SEQ ID NO: 212), RhAd57 (SEQ ID NO: 213), RhAd58 (SEQ ID NO: 214), RhAd59 (SEQ ID NO: 215), RhAD62 (SEQ ID NO: 218), and RhAd66 (SEQ ID NO: 222). The consensus sequence shows regions of conservation and regions of variability. These regions of the consensus sequence can be used to identify amino acid mutations (e.g., additions, deletions, and substitutions) that can be incorporated into the penton proteins of SEQ ID NOs: 210-223 and variants thereof having 90% or more sequence identity (e.g., 91%, 92%, 93%, 94%, 95%, 96%, 97%, 98%, or 99% or more sequence identity). For example, the penton proteins may have any conserved region of 10 or more, 15 or more, 20 or more, 25 or more, 30 or more, 35 or more, 40 or more, 45 or more, or 50 or more amino acid residues of the consensus sequence. Alternately, the variable regions of the consensus sequence may be used to identify amino acids (e.g., 1, 2, 3, 4, 5, 6, 7, 8, 9, 10, 15, 20, or 30 or more amino acids) that may be mutated in the penton proteins of SEQ ID NOs: 210-223 and variants thereof having 90% or more sequence identity.

The SEQ ID NOs corresponding to the full length nucleotide sequence of RhAd54-RhAd67, associated vector sequences of recombinant RhAd54-RhAd67, and the amino acid and nucleic acid sequences for the hexon protein, penton protein, short fiber-1 protein, short fiber-2 protein, and long fiber protein for each of RhAd54-RhAd67 are summarized in Table 1.

at least 90% identical (e.g., at least 91%, 92%, 93%, or 94% identical), at least 95% identical (e.g., at least 96%, 97%, 98%, or 99% identical), or 100% identical to all or a portion of the nucleotide sequence encoding the knob domain of the short fiber (e.g., the knob domain of short fiber-1 and/or

TABLE 1

Summary of adenovirus sequences for RhAd54-RhAd67

| | Hexon | | Penton | | Short-Fiber 1 | | Short-Fiber 2 |
|---|---|---|---|---|---|---|---|
| | Amino Acid | Nucl. | Amino Acid | Nucl. | Amino Acid | Nucl. | Amino Acid |
| RhAd54 | SEQ ID NO: 158 | SEQ ID NO: 54 | SEQ ID NO: 210 | SEQ ID NO: 106 | SEQ ID NO: 120 | SEQ ID NO: 16 | — |
| RhAd55 | SEQ ID NO: 159 | SEQ ID NO: 55 | SEQ ID NO: 211 | SEQ ID NO: 107 | SEQ ID NO: 121 | SEQ ID NO: 17 | SEQ ID NO: 122 |
| RhAd56 | SEQ ID NO: 160 | SEQ ID NO: 56 | SEQ ID NO: 212 | SEQ ID NO: 108 | SEQ ID NO: 123 | SEQ ID NO: 19 | — |
| RhAd57 | SEQ ID NO: 161 | SEQ ID NO: 57 | SEQ ID NO: 213 | SEQ ID NO: 109 | SEQ ID NO: 124 | SEQ ID NO: 20 | SEQ ID NO: 125 |
| RhAd58 | SEQ ID NO: 162 | SEQ ID NO: 58 | SEQ ID NO: 214 | SEQ ID NO: 110 | SEQ ID NO: 126 | SEQ ID NO: 22 | — |
| RhAd59 | SEQ ID NO: 163 | SEQ ID NO: 59 | SEQ ID NO: 215 | SEQ ID NO: 111 | SEQ ID NO: 127 | SEQ ID NO: 23 | SEQ ID NO: 128 |
| RhAd60 | SEQ ID NO: 164 | SEQ ID NO: 60 | SEQ ID NO: 216 | SEQ ID NO: 112 | SEQ ID NO: 129 | SEQ ID NO: 25 | SEQ ID NO: 130 |
| RhAd61 | SEQ ID NO: 165 | SEQ ID NO: 61 | SEQ ID NO: 217 | SEQ ID NO: 113 | SEQ ID NO: 131 | SEQ ID NO: 27 | SEQ ID NO: 132 |
| RhAd62 | SEQ ID NO: 166 | SEQ ID NO: 62 | SEQ ID NO: 218 | SEQ ID NO: 114 | SEQ ID NO: 133 | SEQ ID NO: 29 | — |
| RhAd63 | SEQ ID NO: 167 | SEQ ID NO: 63 | SEQ ID NO: 219 | SEQ ID NO: 115 | SEQ ID NO: 134 | SEQ ID NO: 30 | SEQ ID NO: 135 |
| RhAd64 | SEQ ID NO: 168 | SEQ ID NO: 64 | SEQ ID NO: 220 | SEQ ID NO: 116 | SEQ ID NO: 136 | SEQ ID NO: 32 | SEQ ID NO: 137 |
| RhAd65 | SEQ ID NO: 169 | SEQ ID NO: 65 | SEQ ID NO: 221 | SEQ ID NO: 117 | SEQ ID NO: 138 | SEQ ID NO: 34 | SEQ ID NO: 139 |
| RhAd66 | SEQ ID NO: 170 | SEQ ID NO: 66 | SEQ ID NO: 222 | SEQ ID NO: 118 | SEQ ID NO: 140 | SEQ ID NO: 36 | SEQ ID NO: 141 |
| RhAd67 | SEQ ID NO: 171 | SEQ ID NO: 67 | SEQ ID NO: 223 | SEQ ID NO: 119 | SEQ ID NO: 142 | SEQ ID NO: 38 | SEQ ID NO: 143 |

| | Short-Fiber 2 | Long Fiber | | | |
|---|---|---|---|---|---|
| | Nucl. | Amino Acid | Nucl. | Full Seq. Nucl. | Vectors Nucl. |
| RhAd54 | — | SEQ ID NO: 144 | SEQ ID NO: 40 | SEQ ID NO: 1 | SEQ ID NOs: 224-225 |
| RhAd55 | SEQ ID NO: 18 | SEQ ID NO: 145 | SEQ ID NO: 41 | SEQ ID NO: 2 | SEQ ID NOs: 226-227 |
| RhAd56 | — | SEQ ID NO: 146 | SEQ ID NO: 42 | SEQ ID NO: 3 | SEQ ID NOs: 228-233 |
| RhAd57 | SEQ ID NO: 21 | SEQ ID NO: 147 | SEQ ID NO: 43 | SEQ ID NO: 4 | SEQ ID NOs: 234-235 |
| RhAd58 | — | SEQ ID NO: 148 | SEQ ID NO: 44 | SEQ ID NO: 5 | SEQ ID NOs: 236-239 |
| RhAd59 | SEQ ID NO: 24 | SEQ ID NO: 149 | SEQ ID NO: 45 | SEQ ID NO: 6 | SEQ ID NOs: 240-243 |
| RhAd60 | SEQ ID NO: 26 | SEQ ID NO: 150 | SEQ ID NO: 46 | SEQ ID NO: 7 | SEQ ID NOs: 244-245 |
| RhAd61 | SEQ ID NO: 28 | SEQ ID NO: 151 | SEQ ID NO: 47 | SEQ ID NO: 8 | SEQ ID NOs: 246-247 |
| RhAd62 | — | SEQ ID NO: 152 | SEQ ID NO: 48 | SEQ ID NO: 9 | SEQ ID NOs: 248-249 |
| RhAd63 | SEQ ID NO: 31 | SEQ ID NO: 153 | SEQ ID NO: 49 | SEQ ID NO: 10 | SEQ ID NOs: 250-251 |
| RhAd64 | SEQ ID NO: 33 | SEQ ID NO: 154 | SEQ ID NO: 50 | SEQ ID NO: 11 | SEQ ID NOs: 252-253 |
| RhAd65 | SEQ ID NO: 35 | SEQ ID NO: 155 | SEQ ID NO: 51 | SEQ ID NO: 12 | SEQ ID NOs: 254-255 |
| RhAd66 | SEQ ID NO: 37 | SEQ ID NO: 56 | SEQ ID NO: 52 | SEQ ID NO: 13 | SEQ ID NOs: 256-261 |
| RhAd67 | SEQ ID NO: 39 | SEQ ID NO: 157 | SEQ ID NO: 53 | SEQ ID NO: 14 | SEQ ID NOs: 262-263 |

TABLE 2

Summary of HVRs for the hexon protein of RhAd54-RhAd67

| | | HVR1 | | HVR2 | | HVR3 | | HVR4 | | HVR5 | | HVR6 | | HVR7 | |
|---|---|---|---|---|---|---|---|---|---|---|---|---|---|---|---|
| | Hexon (Nucl.) | start | stop | start | stop | start | stop | start | stop | start | stop | start | stop | start | stop |
| RhAd54 | SEQ ID NO: 158 | 133 | 183 | 192 | 205 | 212 | 217 | 229 | 259 | 265 | 272 | 282 | 298 | 397 | 433 |
| RhAd55 | SEQ ID NO: 159 | 133 | 183 | 192 | 205 | 212 | 217 | 229 | 260 | 266 | 273 | 283 | 299 | 398 | 434 |
| RhAd56 | SEQ ID NO: 160 | 133 | 182 | 191 | 202 | 209 | 214 | 226 | 261 | 267 | 274 | 284 | 300 | 399 | 433 |
| RhAd57 | SEQ ID NO: 161 | 133 | 178 | 187 | 200 | 207 | 212 | 224 | 248 | 254 | 261 | 271 | 287 | 386 | 420 |
| RhAd58 | SEQ ID NO: 162 | 133 | 183 | 192 | 205 | 212 | 217 | 229 | 259 | 265 | 272 | 282 | 298 | 397 | 433 |
| RhAd59 | SEQ ID NO: 163 | 133 | 178 | 187 | 200 | 207 | 212 | 224 | 248 | 254 | 261 | 271 | 287 | 386 | 421 |
| RhAd60 | SEQ ID NO: 164 | 133 | 180 | 189 | 200 | 207 | 212 | 224 | 249 | 255 | 262 | 272 | 286 | 385 | 423 |
| RhAd61 | SEQ ID NO: 165 | 133 | 186 | 195 | 208 | 215 | 220 | 232 | 265 | 271 | 278 | 288 | 304 | 403 | 439 |
| RhAd62 | SEQ ID NO: 166 | 133 | 178 | 187 | 200 | 207 | 212 | 224 | 248 | 254 | 261 | 271 | 287 | 386 | 421 |
| RhAd63 | SEQ ID NO: 167 | 133 | 182 | 191 | 202 | 209 | 214 | 226 | 261 | 267 | 274 | 284 | 300 | 399 | 433 |
| RhAd64 | SEQ ID NO: 168 | 133 | 183 | 192 | 205 | 212 | 217 | 229 | 261 | 267 | 274 | 284 | 300 | 399 | 436 |
| RhAd65 | SEQ ID NO: 169 | 133 | 183 | 192 | 205 | 212 | 217 | 229 | 259 | 265 | 272 | 282 | 298 | 397 | 433 |
| RhAd66 | SEQ ID NO: 170 | 133 | 182 | 191 | 202 | 209 | 214 | 226 | 261 | 267 | 274 | 284 | 300 | 399 | 433 |
| RhAd67 | SEQ ID NO: 171 | 133 | 183 | 192 | 205 | 212 | 217 | 229 | 261 | 267 | 274 | 284 | 300 | 399 | 436 |

The polynucleotides described herein also include all or a portion of the nucleotide sequence encoding the knob domain of the short fiber (e.g., the knob domain of short fiber-1 and/or short fiber-2) protein or long fiber protein of any one of RhAd54-RhAd67. The nucleotide sequences encoding the knob domain of the short fiber protein can be short fiber-2) protein of RhAd54-RhAd67, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of the polypeptide sequences of the knob domain of the short fiber (e.g., the knob domain of short fiber-1 and/or short fiber-2) protein of RhAd54-RhAd67.

The nucleotide sequence encoding the knob domain of the short fiber-1 protein can be at least 90% identical (e.g., at least 91%, 92%, 93%, or 94% identical), at least 95% identical (e.g., at least 96%, 97%, 98%, or 99% identical), or 100% identical to all or a portion of the nucleotide sequences encoding the knob domain of the short fiber-1 protein of RhAd54-RhAd67, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of the polypeptide sequences of the knob domain of the short fiber-1 protein of RhAd54-RhAd67. For example, the isolated polynucleotide described herein can encode a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domain of the short fiber-1 protein of any one of RhAd54 (SEQ ID NO: 172), RhAd55 (SEQ ID NO: 173), RhAd56 (SEQ ID NO: 175), RhAd57 (SEQ ID NO: 176), RhAd58 (SEQ ID NO: 178), RhAd59 (SEQ ID NO: 179), RhAd61 (SEQ ID NO: 183), or RhAd62 (SEQ ID NO: 185).

The nucleotide sequence encoding the knob domain of the short fiber-2 protein can be at least 90% identical (e.g., at least 91%, 92%, 93%, or 94% identical), at least 95% identical (e.g., at least 96%, 97%, 98%, or 99% identical), or 100% identical to all or a portion of any one of the nucleotide sequences encoding the knob domain of the short fiber-2 protein of RhAd55, RhAd57, RhAd59-RhAd61, and RhAd63-RhAd67, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of the polypeptide sequences of the knob domain of the short fiber-2 protein of RhAd55, RhAd57, RhAd59-RhAd61, and RhAd63-RhAd67. For example, the isolated polynucleotide described herein can encode a polypeptide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of the polypeptide sequence encoding the knob domain of the short fiber-2 protein of any one of RhAd60 (SEQ ID NO: 182), RhAd63 (SEQ ID NO: 187), RhAd64 (SEQ ID NO: 189), RhAd65 (SEQ ID NO: 191), RhAd66 (SEQ ID NO: 193), or RhAd67 (SEQ ID NO: 195).

The nucleotide sequence encoding of the knob domain of the long fiber protein can be at least 90% identical (e.g., at least 91%, 92%, 93%, or 94% identical), at least 95% identical (e.g., at least 96%, 97%, 98%, or 99% identical), or 100% identical to all or a portion of any one of the nucleotide sequences encoding the knob domain of the long fiber protein of RhAd54-RhAd67, respectively. The polypeptide sequences of the knob domain of the long fiber protein of RhAd54-RhAd67 correspond to SEQ ID NOs: 196-209, respectively. Also featured are polypeptide sequences with at least 85% sequence identity (e.g., at least 86%, 87%, 88%, or 89% sequence identity), at least 90% sequence identity (e.g., at least 91%, 92%, 93%, or 94% sequence identity), at least 95% sequence identity (e.g., at least 96%, 97%, 98%, or 99% sequence identity), or 100% sequence identity to all or a portion of any one of SEQ ID NOs: 196-209.

The polynucleotides described herein also include all or a portion of one or more of the nucleotide sequences encoding all or a portion of one or more of the short fiber-1 protein, shorter fiber-2 protein, long fiber protein, penton protein, hexon protein, short fiber-1 knob, short fiber-2 knob, and/or long fiber knob protein of one or more of RhAd54-RhAd67 and a nucleotide sequence from one or more adenoviral vectors including, e.g., Ad11, Ad15, Ad24, Ad26, Ad34, Ad35, Ad48, Ad49, Ad50, and/or Pan9 (also known as AdC68) to produce a chimeric adenoviral vector, as discussed below. The nucleotide sequence from Ad11, Ad15, Ad24, Ad26, Ad34, Ad35, Ad48, Ad49, Ad50, and/or Pan9 can encode a short fiber-1, short fiber-2, long fiber, penton, hexon, short fiber-1 knob, short fiber-2 knob, and/or long fiber knob protein and can have at least 90% sequence identity (e.g., at least 91%, 92%, 93%, or 94% sequence identity), at least 95% sequence identity (e.g., at least 96%, 97%, 98%, or 99% sequence identity), or 100% sequence identity to the nucleotide sequence encoding the short fiber-1, short fiber-2, long fiber, penton, hexon, short fiber-1 knob, short fiber-2 knob, and/or long fiber knob protein of the adenoviral vector (e.g., Ad11, Ad15, Ad24, Ad26, Ad34, Ad35, Ad48, Ad49, Ad50, and/or Pan9 (also known as AdC68)).

Vectors

Also featured are recombinant vectors including any one or more of the polynucleotides described above. A vector described herein can be used in conjunction with one or more other vectors (e.g., 1, 2, 3, or more vectors) described herein as a vector system, which can be used to generate recombinant replication-defective RhAds (rdsRhAds) or replication-competent RhAds (rcsRhAds) described herein. Accordingly, featured are adenovirus vector systems for each of the fourteen adenoviruses (RhAd54-RhAd67) described herein. Such a vector system can be used to generate replication-defective adenoviruses according to methods known in the art, which have been applied to generate replication competent adenovirus-free batches based on, for example, Ad5, Ad11, Ad35 and Ad49 (see, e.g., WO 97/00326, WO 00/70071; WO 02/40665; U.S. Pub. No. 2005/0232900, all incorporated herein by reference).

The vectors described herein can contain the E1 region (e.g., a sequence having at least 90% sequence identity to an E1 region defined in Table 3) for the purposes of producing rcsRhAds.

TABLE 3

Summary of E1, E3, and E4 nucleotide boundaries relative to the full RhAd sequence

| | E1 | | E3 | | E4 | |
|---|---|---|---|---|---|---|
| | nt start | nt stop | nt start | nt stop | nt start | nt stop |
| RhAd54 (SEQ ID NO: 1) | 495 | 3088 | 25972 | 28527 | 34080 | 31782 |
| RhAd55 (SEQ ID NO: 2) | 483 | 3094 | 26004 | 28630 | 34832 | 32696 |
| RhAd56 (SEQ ID NO: 3) | 495 | 3090 | 25973 | 28554 | 34106 | 31808 |
| RhAd57 (SEQ ID NO: 4) | 474 | 3088 | 25960 | 28538 | 34741 | 32443 |
| RhAd58 (SEQ ID NO: 5) | 485 | 3091 | 25949 | 28496 | 34007 | 31709 |
| RhAd59 (SEQ ID NO: 6) | 495 | 3090 | 25941 | 28570 | 34773 | 32475 |
| RhAd60 (SEQ ID NO: 7) | 474 | 3081 | 25960 | 28545 | 34826 | 32528 |
| RhAd61 (SEQ ID NO: 8) | 484 | 3100 | 26003 | 28632 | 34856 | 32558 |
| RhAd62 (SEQ ID NO: 9) | 474 | 3088 | 25966 | 28547 | 34104 | 31806 |
| RhAd63 (SEQ ID NO: 10) | 495 | 3090 | 25982 | 28567 | 34696 | 32398 |
| RhAd64 (SEQ ID NO: 11) | 474 | 3090 | 25991 | 28576 | 34857 | 32559 |
| RhAd65 (SEQ ID NO: 12) | 485 | 3101 | 26004 | 28663 | 34904 | 32616 |
| RhAd66 (SEQ ID NO: 13) | 495 | 3072 | 25964 | 28548 | 34829 | 32531 |
| RhAd67 (SEQ ID NO: 14) | 474 | 3090 | 25992 | 28209 | 34772 | 32474 |

The vectors described herein can contain the left-end RhAd sequences and an expression/transgene cassette. The expression cassette of the vector can replace or disrupt all or a portion of the E1 region of the adenovirus. The expression cassette may include, e.g., a promoter (e.g., a CMV promoter, e.g., a CMVlong promoter) that stimulates expression of a transgene, and, optionally, a poly-adenylation signal (e.g., a heterologous nucleotide sequence encoding an antigenic gene product of interest, e.g., a bacterial, viral, parasitic, fungal, or therapeutic protein, or fragment thereof). The E1 region (e.g., a sequence having at least 90% sequence identity to an E1 region defined in Table 3) can be deleted (either partially or completely), disrupted, or rendered inactive by one or more mutations. Such vectors are exemplified, for example, in the Empty vectors described herein (see, e.g., FIGS. 8, 10, 12, 13, 17, 19, 20, 23, 24, 27, 29, 31, 33, 35, 37, 39, 40, and 44, which depict the Empty vectors corresponding to SEQ ID NOs: 224, 226, 228, 229, 234, 236, 237, 240, 241, 244, 246, 248, 250, 252, 254, 256, 257, and 262, which lack the E1 region for each of RhAd54-RhAd67).

The vectors described herein can contain the left part of the RhAd sequences (e.g., the left part of any one of RhAd54-RhAd67), which includes the penton base and 52K coding regions of the RhAd, and/or the right part of the RhAd sequences (e.g., the right part of any one of the RhAd54-RhAd67 genome from approximately pVII to the right ITR (rITR)). The vectors described herein can contain the left part of the RhAd sequences (e.g., the left part of any one of RhAd54-RhAd67), which includes the pIX and pIVa2 coding regions of the RhAd, and/or the right part of the RhAd sequences (e.g., the right part of any one of the RhAd54-RhAd67 genome from approximately pIX to the rITR).

The vectors described herein may have a deleted, disrupted, or mutated E3 (dE3) (e.g., a sequence having at least 90% sequence identity to an E3 region defined in Table 3) and/or E4 (dE4) region (e.g., a sequence having at least 90% sequence identity to an E4 region defined in Table 3), which is not required for replication and packaging of the adenoviral particle. For example, all or a portion of the E3 and/or E4 region may be deleted. Such vectors are exemplified, for example, in the pWe/RhAd.pIX-rITR vectors described herein (see, e.g., FIGS. 9, 11, 13-16, 18, 21, 22, 25, 26, 28, 30, 32, 34, 36, 38, 41-43, and 45, which depict vectors corresponding to SEQ ID NOs: 225, 227, 230-233 234, 235, 238, 239, 242, 243, 245, 247, 249, 251, 253, 255, 258-261, and 263, which lack the E3 region for each of RhAd54-RhAd67).

Deletion of the E3 region is generally preferred if large transgene sequences (e.g., a nucleic acid sequence encoding a heterologous polypeptide (e.g., an antigen from an infective agent or cancer), as described herein) are to be incorporated into the vector since the genome size which can be packaged into a functional particle is limited to approximately 105% of the wild type size. It is to be understood that other modifications may be introduced in the adenoviral genome, such as deletion of the E2A region.

A cell transfected with a vector described herein can complement these deficiencies by delivering the functionality of the missing region(s). The E2A region can be provided by, for instance, a temperature sensitive E2A mutant, or by delivering the E4 functions. Cells that can be used to complement a deficiency of an adenoviral gene (e.g., an E1, E3, and/or E4 deletion) of a vector described herein include, for example, 293 cells or other E1 complementing cells.

Rhesus adenoviral vectors of the invention can efficiently be formed when transfecting the Ad vector constructs in an existing E1-complementing cell line further expressing the 55k protein (e.g., the 55k protein of human Ad serotype 5 and 35, rhesus Ad serotype 52 (see, e.g., GenBank Accession No. AIY35078) and 59, or other known Ad serotypes). 55k can be provided to cells for making the claimed viral vectors via co-expression in the cells (e.g., by co-transfection into the cells or by host cell integration). Co-expression of 55k promotes efficient DNA recombination and hence recombinant virus formation on existing E1-complementing cell lines.

RhAd52 55k protein has the following sequence:

```
  1  meqqrqspvv gvhaglhvdg aveghaaeeg lhllagaasa
     agpsggggra ggdrepegra
 61  gpsngglgae ddpeegtsga rkkqktesep rnflneltvs
     lmnrqrpeti fwseleeefr
121  rgelnllyky gfeqlkthwl epwedfetal dtfakvalrp
     dkvytirrtv nikksvyvig
181  hgalvqvqta drvafscgmq nlgpgvigln gvtfhnvrft
     gesfngsvfa nntqltlhgv
241  yffnfnntcv eswgrvslrg ccfhgcwkav vgrlksvtsv
     kkcvfercvl altvegcgri
301  rnnaasengc flllkgtasv khnmicgsgl ypsqlltcad
     gncqtlrtvh iashqrrawp
361  tfehnmlmrc avhlgprrgv fvpyqcnfsh tkfllepdtf
     srvcfngvfd msmelfkvir
421  ydesksrcrp cecganhlrl ypvtlnvtee lrtdhhmlsc
     lrtdyessde e
```

Many viral vector expression systems are known in the art and modifications of the adenoviral genomes are within the scope of the present invention, which, in principal, relates to the fourteen RhAds described herein (RhAd54-RhAd67) their genomic sequences, or portions thereof, variants thereof, and the use thereof. As described above, any one vector described herein can be used in conjunction with one or more other vectors described herein. In some embodiments, vectors are used which encode both left and right sides of the RhAd genome in order to generate a given RhAd described herein.

Also featured are vectors for the generation of chimeric adenoviruses which include a portion of one or more of the RhAd54-RhAd67 genomes, as well as a portion of the genome of one or more other viruses. The chimeric adenoviral vectors may include a substitution of all or a portion of, e.g., the hexon and/or fiber protein of RhAd54-RhAd67. For example, a portion or all of the hexon protein of RhAd54-RhAd67 may be substituted with that of another virus (e.g., one or more of the hexon protein hypervariable regions (HVRs) of RhAd54-RhAd67 (e.g., a HVR delineated in Table 2 of a hexon protein of any one of RhAd54-RhAd67).

The portion or all of the fiber protein of RhAd54-RhAd67 may be substituted with that of another virus. For example, the fiber knob domain of RhAd54-RhAd67 may be substituted. The substituted regions may be replaced with a region derived from an adenovirus that has a lower seroprevalence compared to that of Ad5, such as subgroup B (Ad11, Ad34, Ad35, and Ad50) and subgroup D (Ad15, Ad24, Ad26, Ad48, and Ad49) adenoviruses, as well as simian adenoviruses (e.g., Pan9, also known as AdC68). An adenoviral vector backbone of Ad5, Ad11, Ad15, Ad24, Ad26, Ad34, Ad48, Ad49, Ad50, or Pan9/AdC68 can also be used to prepare a vector that includes a substitution of all or a portion of one or more of the above hexon HVRs of RhAd54-RhAd67.

Adenoviruses

As discussed above, a recombinant adenovirus derived, at least in part, from one or more of RhAd54-RhAd67 can be generated using the above-described vectors described herein. These adenoviruses may be rcsRhAds or rdsRhAds. rdsRhAds will include a deleted, disrupted, or mutational inactivation of the E1, E2, E3, and/or E4 region. For example, the rdsRhAds may have a deleted, disrupted, or mutational inactivation of the E1 region and may further include a deletion, disruption, or mutational inactivation of the E2, E3, and/or E4 regions.

The adenovirus may include an antigenic or therapeutic gene product, or fragment thereof, including a bacterial, viral, parasitic, or fungal protein, or fragment thereof. The antigenic gene product, or fragment thereof, when expressed in a host, or host cells, is capable of eliciting an immune response (e.g., a B or T cell response).

The bacterial protein, or fragment thereof, may be derived from *Mycobacterium tuberculosis, Mycobacterium bovis, Mycobacterium africanum, Mycobacterium microti, Mycobacterium leprae, Pseudomonas aeruginosa, Salmonella typhimurium, Escherichia coli, Klebsiella pneumoniae, Streptococcus pneumoniae, Staphylococcus aureus, Francisella tularensis, Brucella, Burkholderia mallei, Yersinia pestis, Corynebacterium diphtheria, Neisseria meningitidis, Bordetella pertussis, Clostridium tetani*, or *Bacillus anthracis*. Non-limiting examples of bacterial gene products, or fragments thereof, include 10.4, 85A, 85B, 86C, CFP-10, Rv3871, and ESAT-6 gene products, or fragments thereof, of *Mycobacterium*; O, H, and K antigens, or fragments thereof, of *E. coli*; and protective antigen (PA), or fragments thereof, of *Bacillus anthracis*.

The viral protein, or fragment thereof, may be derived from a virus of a viral family selected from the group consisting of Retroviridae, Flaviviridae, Arenaviridae, Bunyaviridae, Filoviridae, Togaviridae, Poxviridae, Herpesviridae, Orthomyxoviridae, Coronaviridae, Rhabdoviridae, Paramyxoviridae, Picornaviridae, Hepadnaviridae, Papillomaviridae, Parvoviridae, Astroviridae, Polyomaviridae, Caliciviridae, and Reoviridae. The virus may be, e.g., human immunodeficiency virus (HIV), human papillomavirus (HPV), hepatitis A virus (Hep A), hepatitis B virus (HBV), hepatitis C virus (HCV), *Variola major, Variola minor*, monkeypox virus, measles virus, rubella virus, mumps virus, varicella zoster virus (VZV), poliovirus, rabies virus, Japanese encephalitis virus, herpes simplex virus (HSV), cytomegalovirus (CMV), rotavirus, influenza, Ebola virus, yellow fever virus, Zika virus, or Marburg virus. Non-limiting examples of viral gene products, or fragments thereof, include Gag, Pol, Nef, Tat, Rev, Vif, Vpr, or Vpu, or fragments thereof, of HIV and other retroviruses (see, e.g., U.S. Pub. No. 2012/0076812, incorporated by reference herein); 9D antigen, or fragments thereof, of HSV; Env, or fragments thereof, of all envelope protein-containing viruses. For example, the viral protein, or fragment thereof, may be an Env protein or a structured protein. In a particular example, the viral protein may be an HIV or Zika virus Env protein. The viral protein may also be a Gag, Pol, Env, Nef, Tat, Rev, Vif, Vpr, or Vpu protein.

The parasitic protein, or fragment thereof, may be from *Toxoplasma gondii, Plasmodium falciparum, Plasmodium vivax, Plasmodium ovale, Plasmodium malariae, Trypanosoma* spp., or *Legionella* spp. Non-limiting examples of parasitic gene products, or fragments thereof, include circumsporozoite (CS) protein, gamete surface proteins Pfs230 and Pfs48/45, and Liver Specific Antigens 1 or 3 (LSA-1 or LSA-3), or fragments thereof, of *Plasmodium falciparum*.

The fungal protein, or fragment thereof, may be from *Aspergillus, Blastomyces dermatitidis, Candida, Coccidioides immitis, Cryptococcus neoformans, Histoplasma capsulatum* var. *capsulatum, Paracoccidioides brasiliensis, Sporothrix schenckii, Zygomycetes* spp., *Absidia corymbifera, Rhizomucor pusillus*, or *Rhizopus arrhizus*. Non-limiting examples of fungal gene products, or fragments thereof, include any cell wall mannoprotein (e.g., Afmp1 of *Aspergillus fumigatus*) or surface-expressed glycoprotein (e.g., SOWgp of *Coccidioides immitis*).

The therapeutic gene product may be, e.g., interferon (IFN) proteins, Factor VIII, Factor IX, erythropoietin, alpha-1 antitrypsin, calcitonin, glucocerebrosidase, growth hormone, low density lipoprotein (LDL), receptor IL-2 receptor and its antagonists, insulin, globin, immunoglobulins, catalytic antibodies, the interleukins, insulin-like growth factors, superoxide dismutase, immune responder modifiers, parathyroid hormone and interferon, nerve growth factors, tissue plasminogen activators, and/or colony stimulating factors (see, e.g., U.S. Pat. No. 6,054,288, incorporated by reference herein). For example, the IFN protein has an amino acid sequence substantially identical (e.g., at least 70%, 75%, 80%, 85%, 90%, 95%, 96%, 97%, 98%, 99%, or even 100% identical) to the sequence of a human IFN-α (e.g., IFN-α-1a, IFN-α-1 b, IFN-α-2a, IFN-α-2b, and consensus IFN-α (conIFN-α)), a human IFN-β (e.g., IFN-β-1a and IFN-β-1b), a human IFN-γ), or an IFN-T or a polypeptide that demonstrates the same or similar biological activity to an interferon (e.g., at least 50%, 60%, 70%, 75%, 80%, 85%, 90%, 95%, or 100% of the activity of a human IFN-α, a human IFN-β, a human IFN-γ, an IFN-r, or a conIFN-α (see, e.g., U.S. Pat. No. 4,695,623 and U.S. Pub. No. 2011/0000480, incorporated by reference herein, for examples of specific IFN sequences).

In some particular instances, the therapeutic gene products may be a cancer antigen or tumor-associated antigen. Tumor-associated antigens (TAAs) include protein antigens that are overexpressed on the surface of a cancer cell relative to a non-cancerous cell, as well as proteins that arise from mutations of wild-type proteins. A TAA may be tumor-specific, in which case the expression of the antigen is restricted to a particular type of cancer cell. Alternatively, a TAA may be common to several cancers and thus expressed on the surface of a variety of cancer cell types. Examples of TAAs that can be expressed by any adenovirus described herein include one or more tumor-associated antigens listed in the Appendix. For example, the TAA may be an ovarian cancer TAA, a breast cancer TAA, a testicular cancer TAA, a pancreatic cancer TAA, a liver cancer TAA, a colorectal cancer TAA, a thyroid cancer TAA, a lung cancer TAA, a prostate cancer TAA, a kidney cancer TAA, a melanoma TAA, a squamous cell carcinoma TAA, a chronic myeloid leukemia TAA, an acute lympoblastic leukemia TAA, an acute myelogenous leukemia TAA, a chronic lympocytic leukemia TAA, a promyelocytic leukemia TAA, a multiple myeloma TAA, a B cell lymphoma TAA, a bladder carcinoma TAA, a head and neck cancer TAA, an esophageal cancer TAA, a brain cancer TAA, a pharynx cancer TAA, a tumor of the tongue TAA, a synovial cell sarcoma TAA, a neuroblastoma TAA, or a uterine cancer TAA, non-limiting examples for each of which are further listed in the Appendix. Additional examples of TAAs are known in the art and are described, e.g., in Reuschenbach et al., *Cancer Immunol. Immunother.* 58:1535-1544 (2009); Parmiani et al., *J. Nat. Cancer Inst.* 94:805-818 (2002); Zarour et al., *Cancer Medicine*. (2003); Bright et al., *Hum. Vaccin. Immunother.* 10:3297-3305 (2014); Wurz et al., *Ther. Adv. Med. Oncol.* 8:4-31 (2016); Criscitiello, *Breast Care* 7:262-266 (2012); Chester et al., *J. Immunother. Cancer* 3:7 (2015); Li et al., *Mol. Med. Report* 1:589-594 (2008); Liu et al., *J. Hematol. Oncol.* 3:7 (2010); Bertino et al., *Biomed. Res. Int.* 731469 (2015); and Suri et al., *World J. Gastrointest. Oncol.* 7:492-502 (2015), the disclosures of each of which are incorporated herein by reference in their entirety.

The recombinant adenoviruses described herein may also be characterized by the cellular entry receptor to which it binds. For example, the adenovirus may bind to a CAR receptor, a sialic acid receptor, a CD46 receptor, or a CD55 receptor. For example, the recombinant adenovirus that binds a sialic acid receptor may be encoded by a polynucleotide including a nucleotide sequence that is at least 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) of SEQ ID NO: 10 (e.g., RhAd63), or its complement. In particular instances, the recombinant adenovirus that binds a sialic acid receptor contains three fiber proteins that are at least 85% identical (e.g., at least 86%, 87%, 88%, or 89% identical), 90% identical (e.g., at least 91%, 92%, 93%, or 94% identical), at least 95% identical (e.g., at least 96%, 97%, 98%, or 99% identical), or 100% identical to all or a portion (e.g., 20 or more consecutive nucleic acids) to SEQ ID NOs: 134, 135, and 153, respectively Methods of Prophylaxis or Treatment Adenoviruses and vectors described herein can be used to prepare pharmaceutical compositions. The pharmaceutical compositions can be used as immunogenic compositions (e.g., vaccines) for treating a subject (e.g., a human) with a disease (e.g., cancer or a disease caused by an infective agent, e.g., AIDS).

In particular, the pharmaceutical compositions can be used to treat (pre- or post-exposure) or prevent (e.g., reduce the risk or extent of) infection by bacteria, including *Mycobacterium tuberculosis, Mycobacterium bovis, Mycobacterium africanum, Mycobacterium microti, Mycobacterium leprae, Pseudomonas aeruginosa, Salmonella typhimurium, Escherichia coli, Klebsiella pneumoniae, Streptococcus pneumoniae, Staphylococcus aureus, Francisella tularensis, Brucella, Burkholderia mallei, Yersinia pestis, Corynebacterium diphtheria, Neisseria meningitidis, Bordetella pertussis, Clostridium tetani*, or *Bacillus anthracis*; viruses of a viral family selected from the group consisting of Retroviridae, Flaviviridae, Arenaviridae, Bunyaviridae, Filoviridae, Togaviridae, Poxviridae, Herpesviridae, Orthomyxoviridae, Coronaviridae, Rhabdoviridae, Paramyxoviridae, Picornaviridae, Hepadnaviridae, Papillomaviridae, Parvoviridae, Astroviridae, Polyomaviridae, Calciviridae, and Reoviridae; parasites, including *Toxoplasma gondii, Plasmodium falciparum, Plasmodium vivax, Plasmodium ovale, Plasmodium malariae, Trypanosoma* spp., or *Legionella* spp.; and fungi, including *Aspergillus, Blastomyces dermatitidis, Candida, Coccidioides immitis, Cryptococcus neoformans, Histoplasma capsulatum* var. *capsulatum, Paracoccidioides*

*brasiliensis, Sporothrix schenckii, Zygomycetes* spp., *Absidia corymbifera, Rhizomucor pusillus,* or *Rhizopus arrhizus.*

The pharmaceutical compositions described herein can be used to treat or prevent diseases caused by infectious agents (e.g., viral infections, e.g., AIDS or Zika infection). In non-limiting examples, the pharmaceutical compositions can be used to treat a subject (e.g., a human) with acquired immune deficiency syndrome (AIDS), cancer, tuberculosis, leprosy, typhoid fever, pneumonia, meningitis, staphylococcal scalded skin syndrome (SSSS), Ritter's disease, tularemia (rabbit fever), brucellosis, Glanders disease, bubonic plague, septicemic plague, pneumonic plague, diphtheria, pertussis (whooping cough), tetanus, anthrax, hepatitis, smallpox, monkeypox, measles, mumps, rubella, chicken pox, polio, rabies, Japanese encephalitis, herpes, mononucleosis, influenza, Ebola virus disease, hemorrhagic fever, yellow fever, Marburg virus disease, toxoplasmosis, malaria, trypanosomiasis, legionellosis, aspergillosis, blastomycosis, candidiasis (thrush), coccidioidomycosis, cryptococcosis, histoplasmosis, paracoccidioidomycosis, sporotrichosis, Zika infection, or sinus-orbital zygomycosis.

Further, the pharmaceutical compositions described herein can also be used to treat or prevent cancer. Non-limiting examples of cancers that can be treated using the recombinant adenoviruses or vectors described herein include carcinoma, lymphoma, blastoma, sarcoma, and leukemia or lymphoid malignancies. For instance, the cancer can be an ovarian cancer, a breast cancer, a testicular cancer, a pancreatic cancer, a liver cancer, a colorectal cancer, a thyroid cancer, a lung cancer, a prostate cancer, a kidney cancer, a melanoma, a squamous cell carcinoma, a chronic myeloid leukemia, an acute lympoblastic leukemia, an acute myelogenous leukemia, a chronic lympocytic leukemia, a promyelocytic leukemia, a multiple myeloma, a B cell lymphoma, a bladder carcinoma, a head and neck cancer, an esophageal cancer, a brain cancer, a pharynx cancer, a tumor of the tongue, a synovial cell sarcoma, a neuroblastoma, or a uterine cancer. More particular examples of such cancers include, but are not limited to, lung cancer, including small-cell lung cancer, non-small cell lung cancer, adenocarcinoma of the lung, and squamous carcinoma of the lung; bladder cancer (e.g., urothelial bladder cancer (UBC), muscle invasive bladder cancer (MIBC), and BCG-refractory non-muscle invasive bladder cancer (NMIBC)); kidney or renal cancer (e.g., renal cell carcinoma (RCC)); cancer of the urinary tract; breast cancer (e.g., HER2+ breast cancer and triple-negative breast cancer (TNBC), which are estrogen receptors (ER−), progesterone receptors (PR−), and HER2 (HER2−) negative); prostate cancer, such as castration-resistant prostate cancer (CRPC); cancer of the peritoneum; hepatocellular cancer; gastric or stomach cancer, including gastrointestinal cancer and gastrointestinal stromal cancer; pancreatic cancer; glioblastoma; cervical cancer; ovarian cancer; liver cancer; hepatoma; colon cancer; rectal cancer; colorectal cancer; endometrial or uterine carcinoma; salivary gland carcinoma; prostate cancer; vulval cancer; thyroid cancer; hepatic carcinoma; anal carcinoma; penile carcinoma; melanoma, including superficial spreading melanoma, lentigo maligna melanoma, acral lentiginous melanomas, and nodular melanomas; multiple myeloma and B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia); chronic lymphocytic leukemia (CLL); acute lymphoblastic leukemia (ALL); acute myologenous leukemia (AML); hairy cell leukemia; chronic myeloblastic leukemia (CML); post-transplant lymphoproliferative disorder (PTLD); and myelodysplastic syndromes (MDS), as well as abnormal vascular proliferation associated with phakomatoses, edema (such as that associated with brain tumors), Meigs' syndrome, brain cancer, head and neck cancer, and associated metastases.

Immune Response

The recombinant adenoviruses described herein (e.g., RhAd54-RhAd67 or variant thereof) can be used in a regimen for inducing an immune response in a subject following ex vivo or in vivo administration. In one instance, the immune response induced is a humoral (i.e., antibody) response to the product expressed by the viral vectors. Depending upon the antigen product expressed, such an antibody response can be specific to the antigen from which the antigen is derived or cross-reactive with other, related antigens. In another instance, the immune response can be a cellular (e.g., CTL) response. Depending upon the immunogenic product expressed, such a CTL response can be specific to the antigen from which the immunogen is derived or cross-reactive with other, related antigens. In still other instances, both an antibody response and a CTL response may be induced.

The recombinant adenoviruses described herein can be used in immunization regimens that can be applied either in prophylactic or therapeutic compositions. Such immunogenic compositions are formulated in a suitable delivery vehicle, as described herein. Generally, doses for the immunogenic compositions are in the range defined herein for therapeutic compositions. The levels of immunity can be monitored to determine the need, if any, for boosters. Following an assessment of antibody titers in the serum, optional booster immunizations may be desired (see "Prime-Boost Regimens" section).

The pharmaceutical composition may include an adenovirus (e.g., RhAd54-RhAd67 or variant thereof) or vector that is modified to express one or more antigens in order to produce an immune response that treats a disease or disorder (e.g., a bacterial infection, a viral infection, or a cancer). For example, a recombinant RhAd54-RhAd67 adenovirus or vector that is modified to express the Env glycoprotein of HIV or Zika virus can be used to treat infection by HIV or Zika virus, respectively. As another example, a recombinant RhAd54-RhAd67 adenovirus or vector that is modified to express a cancer antigen or a tumor-associated antigen, such as the antigens listed in the Appendix, can be used to treat cancer.

In some instances, immune responses induced by use of the vectors or recombinant adenoviruses expressing an antigen described herein may involve upregulation (e.g., upregulation by a log fold change of about +1, +2, +3, +4, +5, +6, +7, +8, +9, +10, +11, +12, +13, +14, or +15) or downregulation (e.g., downregulation by a log fold change of about −1, −2, −3, −4, −5, −6, −7, −8, −9, −10, −11, −12, −13, −14, or −15) of a one or more genes. For example, the immune response may involve upregulation and/or downregulation of one or more genes in pro-inflammatory signaling pathways, TCR signaling pathways, BCR signaling pathways, T-help cells markers, NK cells activation markers, growth factors, T cell proliferation and differentiation markers, program cell death markers, NFKB signaling markers, STAT signaling markers, TGF-beta signaling markers, or negative immune regulators. In some instances, an immune response may include upregulation (e.g., upregulation by a log fold change of about +1, +2, +3, +4, +5, +6, +7, +8, +9, +10, +11, +12, +13, +14, or +15) or downregulation (e.g., downregulation by a log fold change of about −1, −2, −3, −4, −5, −6, −7, −8, −9, −10, −11, −12, −13, −14, or −15) of expression of a gene, such as, e.g., one or more of TNF-α, IL1-α, IL1β, IL-2, Il-2ra, IL-4, IL-5, IL-6, IL-7, IL-9, IL-10, IL-13, IL-15, IP10 (CXCL10), IL-12 (P40), IL-12 (P70), IL-18, Eotaxin (CCL11), KC (CXCL1), MCP-1 (CCL2), MIP-1a (CCL3), MIP-1b (CCL4), MIP2 (CXCL2), MIG (CXCR3), LIX (CXCL5), RANTES (CCL5), IFN-γ, G-CSF, CCL19, CXCL11, GM-CSF, CD40, CD40LG, NFATC3, NFATC4, CD28, CCR4, CD34, CD38, CD3e, CD4, CD68, CD80, CD86, CD8a, LY96, VCAM1, C3, CD19, ICOS, TBX21, IL-15, VEGF, CSF1, CSF2, CSF3, BCL2, BCL2L1, AGTR2, BAX, FAS, FASL, GZMB, LCAM1, PRF1, SOCS1, SOCS2, Tnfrsf18, NFKB1, NFKB2, IKBKB, Stat1, Stat2, Stat3, STAT4, STATE, SMAD3, SMAD7, TGFB1, CTLA4, ACE, EDN1, FN1, H2-Ea, H2-Eb1, LIF, LRP2, NOS2, PTGS2, PTPRC, SELE, SELP, or SKI (see, e.g., the methodology of Example 1). For example, the recombinant adenoviruses described herein (e.g., RhAd55, RhAd58, RhAd59, RhAd62, RhAd65, and RhAd66) may induce an immune response that involves downregulation of IL-9 relative to a reference level (e.g., as compared to expression of one or more control genes (e.g., a housekeeping gene), expression of the same gene in a different sample (e.g., one or more control samples), or expression of the same gene in the same sample at one or more earlier time points).

In some instances, the immune response induced by use of the vectors or recombinant adenoviruses or vectors expressing an antigen described herein may include downregulation (e.g., decreased expression) of a gene described herein, in which the expression of the gene is decreased by about 10%, 20%, 30%, 40%, 50%, 60%, 70%, 80%, 90%, 95%, 96%, 97%, 98%, or 99% or greater as compared to a reference level (e.g., as compared to expression of one or more control genes (e.g., a housekeeping gene), expression of the same gene in a different sample (e.g., one or more control samples), or expression of the same gene in the same sample at one or more earlier time points). In certain instances, downregulation of the gene involves a decrease in gene expression that is at least about 1.5×, 1.75×, 2×, 3×, 4×, 5×, 6×, 7×, 8×, 9×, 10×, 25×, 50×, 75×, or 100× fold less than a reference level (e.g., as compared to expression of one or more control genes (e.g., a housekeeping gene), expression of the same gene in a different sample (e.g., one or more control samples), or expression of the same gene in the same sample at one or more earlier time points).

In some instances, the immune response induced by use of the vectors or recombinant adenoviruses expressing an antigen described herein may include upregulation (e.g., increased expression) of a gene described herein, in which the expression of the gene is increased by about 10%, 20%, 30%, 40%, 50%, 60%, 70%, 80%, 90%, 95%, 96%, 97%, 98%, or 99% or more as compared to a reference level (e.g., as compared to expression of one or more control genes (e.g., a housekeeping gene), expression of the same gene in a different sample (e.g., one or more control samples), or expression of the same gene in the same sample at one or more earlier time points). In certain instances, upregulation of the gene involves an increase in gene expression that is at least about 1.5×, 1.75×, 2×, 3×, 4×, 5×, 6×, 7×, 8×, 9×, 10×, 25×, 50×, 75×, or 100× fold less than a reference level (e.g., as compared to expression of one or more control genes (e.g., a housekeeping gene), expression of the same gene in a different sample (e.g., one or more control samples), or expression of the same gene in the same sample at one or more earlier time points).

Pharmaceutical Formulation and Administration of the Compositions

Administration

The pharmaceutical compositions described herein can be administered to a subject (e.g., a human), pre- or post-exposure to an infective agent (e.g., bacteria, viruses, parasites, fungi) or pre- or post-diagnosis of a disease of a disease without an etiology traceable to an infective agent (e.g., cancer), to treat, prevent, ameliorate, inhibit the progression of, or reduce the severity of one or more symptoms of the disease in the subject. For example, the compositions described herein can be administered to a subject to treat having AIDS. Examples of symptoms of diseases caused by a viral infection, such as AIDS, that can be treated using the compositions described herein include, for example, fever, muscle aches, coughing, sneezing, runny nose, sore throat, headache, chills, diarrhea, vomiting, rash, weakness, dizziness, bleeding under the skin, in internal organs, or from body orifices like the mouth, eyes, or ears, shock, nervous system malfunction, delirium, seizures, renal (kidney) failure, personality changes, neck stiffness, dehydration, seizures, lethargy, paralysis of the limbs, confusion, back pain, loss of sensation, impaired bladder and bowel function, and sleepiness that can progress into coma or death. These symptoms, and their resolution during treatment, may be measured by, for example, a physician during a physical examination or by other tests and methods known in the art.

The compositions utilized in the methods described herein can be formulated, for example, for administration intramuscularly, intravenously, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctivally, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in cremes, or in lipid compositions. The methods of the invention include the administration of the compositions described herein by one or more of these routes.

The method of administration can vary depending on various factors (e.g., the components of the composition being administered and the severity of the condition being treated). Formulations suitable for oral or nasal administration may consist of liquid solutions, such as an effective amount of the composition dissolved in a diluent (e.g., water, saline, or PEG-400), capsules, sachets, tablets, or gels, each containing a predetermined amount of the chimeric Ad5 vector composition described herein. The pharmaceutical composition may also be an aerosol formulation for inhalation, for example, to the bronchial passageways. Aerosol formulations may be mixed with pressurized, pharmaceutically acceptable propellants (e.g., dichlorodifluoromethane, propane, or nitrogen). In particular, administration by inhalation can be accomplished by using, for example, an aerosol containing sorbitan trioleate or oleic acid, for example, together with trichlorofluoromethane, dichlorofluoromethane, dichlorotetrafluoroethane, or any other biologically compatible propellant gas.

Immunogenicity of the composition may be significantly improved if it is co-administered with an immunostimulatory agent or adjuvant. Suitable adjuvants well-known to those skilled in the art include, for example, aluminum phosphate, aluminum hydroxide, QS21, Quil A (and derivatives and components thereof), calcium phosphate, calcium hydroxide, zinc hydroxide, glycolipid analogs, octodecyl esters of an amino acid, muramyl dipeptides, polyphosphazene, lipoproteins, ISCOM matrix, DC-Chol, DDA, cytokines, and other adjuvants and derivatives thereof.

Pharmaceutical compositions described herein may be formulated to release the composition immediately upon administration (e.g., targeted delivery) or at any predetermined time period after administration using controlled or extended release formulations. Administration of the pharmaceutical composition in controlled or extended release formulations is useful where the composition, either alone or in combination, has (i) a narrow therapeutic index (e.g., the difference between the plasma concentration leading to harmful side effects or toxic reactions and the plasma concentration leading to a therapeutic effect is small; generally, the therapeutic index, TI, is defined as the ratio of median lethal dose ($LD_{50}$) to median effective dose ($ED_{50}$)); (ii) a narrow absorption window at the site of release (e.g., the gastro-intestinal tract); or (iii) a short biological half-life, so that frequent dosing during a day is required in order to sustain a therapeutic level.

Many strategies can be pursued to obtain controlled or extended release in which the rate of release outweighs the rate of metabolism of the pharmaceutical composition. For example, controlled release can be obtained by the appropriate selection of formulation parameters and ingredients, including, e.g., appropriate controlled release compositions and coatings. Suitable formulations are known to those of skill in the art. Examples include single or multiple unit tablet or capsule compositions, oil solutions, suspensions, emulsions, microcapsules, microspheres, nanoparticles, patches, and liposomes.

The compositions may be administered to provide pre-exposure prophylaxis or after a subject has been diagnosed with an infection or a disease without an etiology traceable to an infective agent (e.g., cancer), or after exposure to an infective agent, such as a bacterium, virus, parasite, or fungus. The composition may be administered, for example, 1, 2, 3, 4, 5, 6, 7, 8, 9, 10, 15, 20, 30, 35, 40, 45, 50, 55, or 60 minutes, 2, 4, 6, 10, 15, or 24 hours, 2, 3, 5, or 7 days, 2, 4, 6 or 8 weeks, or even 3, 4, or 6 months pre-exposure or pre-diagnosis, or may be administered to the subject 15-30 minutes or 1, 2, 3, 4, 5, 6, 7, 8, 9, 10, 12, 20, 24, 48, or 72 hours, 2, 3, 5, or 7 days, 2, 4, 6 or 8 weeks, 3, 4, 6, or 9 months, 1, 2, 3, 4, 5, 6, 7, 8, 9, 10, 15, or 20 years or longer post-diagnosis or post-exposure to the infective agent.

When treating disease (e.g., AIDS or cancer), the compositions may be administered to the subject either before the occurrence of symptoms or a definitive diagnosis or after diagnosis or symptoms become evident. For example, the composition may be administered, for example, immediately after diagnosis or the clinical recognition of symptoms or 2, 4, 6, 10, 15, or 24 hours, 2, 3, 5, or 7 days, 2, 4, 6 or 8 weeks, or even 3, 4, or 6 months after diagnosis or detection of symptoms.

The compositions may be sterilized by conventional sterilization techniques, or may be sterile filtered. The resulting aqueous solutions may be packaged for use as is, or lyophilized, the lyophilized preparation may be administered in powder form or combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of the recombinant replication-defective RhAd vector containing a heterologous nucleic acid encoding an antigenic gene product, or fragment thereof, (e.g., an RhAd54-RhAd67 HIV Gag delivery vector) and, if desired, one or more immunomodulatory agents, such as in a sealed package of tablets or capsules, or in a suitable dry powder inhaler (DPI) capable of administering one or more doses.

Dosages

A dose of the pharmaceutical compositions described herein (e.g., the number of antigenic gene product-encoding recombinant RhAd vectors) or the number of treatments using the compositions described herein may be increased or decreased based on the severity of, occurrence of, or progression of, the disease in the subject (e.g., based on the severity of one or more symptoms of, e.g., viral infection or cancer).

The pharmaceutical compositions can be administered in a therapeutically effective amount that provides an immunogenic and/or protective effect against an infective agent or target protein for a disease caused by a non-infective agent. For example, the subject can be administered at least about $1 \times 10^3$ viral particles (vp)/dose or between $1 \times 10^1$ and $1 \times 10^{14}$ vp/dose, preferably between $1 \times 10^3$ and $1 \times 10^{12}$ vp/dose, and more preferably between $1 \times 10^5$ and $1 \times 10^{11}$ vp/dose.

Viral particles include nucleic acid molecules encoding an antigenic gene product or fragment thereof (e.g., viral structural and non-structural proteins) and are surrounded by a protective coat (a protein-based capsid with hexon and fiber proteins, which may be derived from a single RhAd described herein or a chimeric variant thereof). Viral particle number can be measured based on, for example, lysis of vector particles, followed by measurement of the absorbance at 260 nm (see, e.g., Steel, Curr. Opin. Biotech., 1999).

The dosage administered depends on the subject to be treated (e.g., the age, body weight, capacity of the immune system, and general health of the subject being treated), the form of administration (e.g., as a solid or liquid), the manner of administration (e.g., by injection, inhalation, dry powder propellant), and the cells targeted (e.g., epithelial cells, such as blood vessel epithelial cells, nasal epithelial cells, or pulmonary epithelial cells). The composition is preferably administered in an amount that provides a sufficient level of the antigenic or therapeutic gene product, or fragment thereof (e.g., a level of an antigenic gene product that elicits an immune response without undue adverse physiological effects in the host caused by the antigenic gene product).

In addition, single or multiple administrations of the compositions may be given (pre- or post-exposure and/or pre- or post-diagnosis) to a subject (e.g., one administration or administration two or more times). For example, subjects who are particularly susceptible to, for example, viral infection may require multiple treatments to establish and/or maintain protection against the virus. Levels of induced immunity provided by the pharmaceutical compositions described herein can be monitored by, for example, measuring amounts of neutralizing secretory and serum antibodies. The dosages may then be adjusted or repeated as necessary to trigger the desired level of immune response. For example, the immune response triggered by a single administration (prime) of a composition described herein may not sufficiently potent and/or persistent to provide effective protection. Accordingly, in some instances, repeated administration (boost), such that a prime-boost regimen is established, can significantly enhance humoral and cellular responses to the antigen of the composition. The RhAd54-RhAd67 vectors are well suited for use in a variety of immunization and therapeutic regimens. Such regimens may involve delivery of one or more of the RhAd54-RhAd67 vectors simultaneously or sequentially with an Ad vector of a different serotype capsid, regimens in which one or more of the RhAd54-RhAd67 vectors are delivered simultaneously or sequentially with a non-Ad vector, regimens in which one or more of the RhAd54-RhAd67 vectors are delivered simultaneously or sequentially with proteins, peptides, and/or other biologically useful therapeutic or immunogenic compounds. The prime-boost regimens may be either homologour prime-boost or heterologous prime-boost. Such uses will be readily apparent to one of skill in the art.

Alternatively, the efficacy of treatment can be determined by monitoring the level of the antigenic or therapeutic gene product, or fragment thereof, expressed in a subject (e.g., a human) following administration of the compositions described herein. For example, the blood or lymph of a subject can be tested for antigenic or therapeutic gene product, or fragment thereof, using, for example, standard assays known in the art (see, e.g., Human Interferon-Alpha Multi-Species ELISA kit (Product No. 41105) and the Human Interferon-Alpha Serum Sample kit (Product No. 41110) from Pestka Biomedical Laboratories (PBL), Piscataway, N.J.).

A single dose of the compositions may achieve protection, pre-exposure or pre-diagnosis. In addition, a single dose administered post-exposure or post-diagnosis can function as a treatment according to the present invention.

A single dose of the compositions can also be used to achieve therapy in subjects being treated for a disease. Multiple doses (e.g., 2, 3, 4, 5, or more doses) can also be administered, if necessary, to these subjects.

Prime-Boost Regimens

The compositions described herein (e.g., recombinant RhAd54-RhAd67 adenovirus or vector) can be used in prime-boost treatment regimens. Prime-boost regimens involve the administration of a first immunogenic composition (the priming composition) followed by administration of a second immunogenic composition (the boosting composition) to a subject to induce an immune response. The boosting composition is administered to the subject after the priming composition; the skilled artisan will understand a suitable time interval between administration of the priming composition and the boosting composition, and examples of such time frames are disclosed herein.

The primary requirements of the boosting composition are that the antigen of the composition is the same antigen, or a cross-reactive antigen, as that encoded by the priming composition. The boosting composition may be composed of a recombinant viral vector (e.g., RhAd54-RhAd67 adenoviral sequences, respectively) derived from the same viral source or from another source relative to the priming composition (e.g., a homologous or heterologous prime-boost regimen). Alternatively, the boosting composition can be a composition containing the same antigen as encoded in the priming composition, but in the form of a protein or peptide, in which the composition induces an immune response in the host. In other instances, the boosting composition contains a DNA sequence encoding the antigen under the control of a regulatory sequence directing its expression in a mammalian cell.

The prime-boost regimens may deliver any antigen(s) known in the art, including those described herein, e.g., a bacterial antigen, a viral antigen, a fungal antigen, or a cancer antigen described herein. For example, priming may involve delivering with a first RhAd vector (e.g., RhAd54-RhAd67) followed by boosting with a second RhAd vector (e.g., RhAd54-RhAd67), or with a composition containing the antigen itself in protein form. In one example, the prime-boost regimen can provide a protective immune response to the virus, bacteria, or other organism from which the antigen is derived. In another instance, the prime-boost regimen provides a therapeutic effect that can be measured using conventional assays for detection of the presence of, or amelioration of, the condition for which therapy is being administered. The level of an immunogenic response against the selected antigen(s) can be monitored to determine the need, if any, for a booster(s). An assessment of $CD8^+$ T cell response, or optionally, antibody titers, in the serum, can be used to determine whether optional booster immunizations may be needed.

In some instances the same vector (e.g., a recombinant RhAd54-RhAd67 vector) is used to deliver the one or more antigens in the priming composition and in the boosting composition. Alternatively, the recombinant adenovirus vectors may be delivered in a combination regimen involving sequential administration, or co-administration, with a different vector. These regimens can further include sequential or co-administration administration with one or more additional adenovirus vectors, e.g., a functionally E1-deleted and/or functionally E4-deleted adenovirus or one or more additional vectors or other therapeutic and/or vaccine agents.

In some instances, the vector (e.g., a recombinant RhAd54-RhAd67 vector) used to deliver an antigen in the priming composition is different than the vector (e.g., a recombinant RhAd54-RhAd67 vector) used to deliver the antigen in the boosting composition. For instance, as outlined in Example 6, a prime-boost regimen may include the use of a human Ad (HuAd) vector (e.g., HuAd5 or HuAd26) and a RhAd vector (e.g., a recombinant RhAd54-RhAd67 vector described herein, or other RhAds, such as any one of RhAd51-RhAd53, as described in US 2015/0291935, incorporated herein by reference). Alternatively, the prime-boost regimen may include the use of one RhAd vector (e.g., a recombinant RhAd54-RhAd67 vector) in the priming composition and a second, different RhAd vector (e.g., a recombinant RhAd54-RhAd67 vector, a human Ad (HuAd) vector (e.g., HuAd5 or HuAd26), or any one of RhAd51-RhAd53, as described in US 2015/0291935). In some particular instances, the prime-boost regimen may involve administration of a priming composition including a recombinant RhAd56 vector. In other particular instances, the prime-boost regimen may involve administration of a boosting composition including a recombinant RhAd56 vector. The prime or boost vector may be, e.g., an RhAd52 vector.

Additional vectors known in the art may be used in the prime-boost regimen. For example, a variety of adenovirus strains are available from the American Type Culture Collection, Manassas, Va., or available by request from a variety of commercial and institutional sources. Further, the sequences of many such strains are available from a variety of databases including, e.g., PubMed and GenBank. Adenovirus vectors prepared from other simian or from human adenoviruses are described in the published literature. The DNA sequences of a number of adenovirus types are available from the GenBank™ database, including type Ad5 (GenBank™ Accession No. M73260). The adenovirus sequences may be obtained from any known adenovirus serotype, such as serotypes C, D, 1-40, and 2, 3, 4, 5, 7, 12 and 40, and other known human types. Similarly adenoviruses known to infect non-human animals (e.g., simians)

may also be employed in the vector constructs of this invention. Examples of suitable non-human primate vectors that can be used as part of a prime-boost regimen herein include simian adenoviruses, such as, PanS (also C5), Pan6 (also C6), Pan7 (also C7), SV1, SV25, SV39 (see, WO 02/33645, incorporated by reference), and Pan 9 (also C68) and Cl (U.S. Pat. No. 6,083,716, incorporated by reference), and SA 18 (U.S. Pat. No. 7,291,498) and its international counterpart WO 2005/001103, incorporated herein by reference). Other vectors that can be used in a prime-boost regimen include pseudotyped adenoviruses, chimeric and hybrid adenoviral vectors. See, e.g., U.S. Pat. No. 7,291,498 and WO 2005/001103, incorporated herein by reference.

The priming composition or boosting composition can be administered at various sites in the body. The regimen may involve a priming and boosting step, each of which may include a dose or dosage that is administered one or more times hourly, daily, weekly, biweekely, monthly, bi-monthly, or yearly. The amount or site of delivery is may be selected based upon the identity and condition of the subject.

The dosage unit of the priming or boosting composition suitable for delivery of the antigen to the subject can be based on the dosages described herein. For example, the priming or boosting composition can be prepared for administration by being suspended or dissolved in a pharmaceutically or physiologically acceptable carrier such as isotonic saline; isotonic salts solution or other formulations that will be apparent to those skilled in such administration. The appropriate carrier will be evident to those skilled in the art and will depend in large part upon the route of administration. The compositions described herein may be administered to a subject according to administration routes described herein, in a sustained release formulation using a biodegradable biocompatible polymer, or by on-site delivery using micelles, gels and liposomes. Optionally, the priming step also includes administering with the priming composition, a suitable amount of an adjuvant, such as are defined herein.

Dosages of the priming composition or boosting composition will depend primarily on factors such as the condition being treated, the age, weight and health of the patient, and may thus vary among mammalian (including human) patients. In some instances, a significantly lower amount of the recombinant adenovirus relative to administration of the adenovirus in non-prime-boost regimen can be used to provide an effective amount to induce the desired immunogenic effect (e.g., induction of a predetermined level of antibodies and/or $CD8^+$ T cells). In some instances, an effective dosage of the priming or boosting composition in the range of from about 0.1 ml to about 100 ml of solution containing concentrations of from about $1\times10^9$ to $1\times10^{16}$ genomes virus vector. For example, the subject can be administered at least about $1\times10^3$ viral particles (vp)/dose or between $1\times10^1$ and $1\times10^{14}$ vp/dose, preferably between $1\times10^3$ and $1\times10^{12}$ vp/dose, and more preferably between $1\times10^5$ and $1\times10^{11}$ vp/dose of the vector in the priming composition and/or the boosting composition.

Depending upon the desired routes of administration, one of skill in the art can select an appropriate regimen. In general, a second, or subsequent immunization, composition can be administered about 2 to about 27 weeks after administering the preceding immunization composition, to the mammalian subject. The administration of the subsequent composition is accomplished using an effective amount of a composition containing or capable of delivering the same antigen as administered by the prior composition. Desirably, the product of the boosting composition is the same, or cross-reactive, as that encoded by the priming composition.

The time period between sequential administrations, according to the present invention, can be adjusted according to the order of vector-mediated delivery, and any optional additional priming or boosting compositions (e.g., DNA-based or protein-based immunogenic compositions). For example, peak immune response is generally observed about 10 to 14 days following an Ad-mediated delivery. However, boosting following this peak may generate a second peak. Thus, it may be desirable to time expression of a boosting antigen to express from about 10 to 21 days, or 18 to 28 days, or 28 days to 27 weeks following Ad-mediated delivery.

Carriers, Excipients, Diluents

The compositions described herein include RhAd vectors (e.g., vectors encoding a portion or all of any one of RhAd54-RhAd67, or variants thereof, as described herein) containing a heterologous nucleic acid molecule encoding an antigenic or therapeutic gene product, or fragment thereof. Therapeutic formulations of the compositions described herein are prepared using standard methods known in the art by mixing the active ingredient having the desired degree of purity with optional physiologically acceptable carriers, excipients or stabilizers (Remington's Pharmaceutical Sciences (20th edition), ed. A. Gennaro, 2000, Lippincott, Williams & Wilkins, Philadelphia, Pa.). Acceptable carriers, include saline, or buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagines, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™, or PEG.

Optionally, but preferably, the formulation contains a pharmaceutically acceptable salt, preferably sodium chloride, and preferably at about physiological concentrations. Optionally, the formulations described herein can contain a pharmaceutically acceptable preservative. In some embodiments the preservative concentration ranges from 0.1 to 2.0%, typically v/v. Suitable preservatives include those known in the pharmaceutical arts. Benzyl alcohol, phenol, m-cresol, methylparaben, and propylparaben are preferred preservatives. Optionally, the formulations described herein can include a pharmaceutically acceptable surfactant at a concentration of 0.005 to 0.02%.

Combination Therapies

The pharmaceutical compositions described herein may optionally be administered in combination with an additional therapeutic agent. For example, the pharmaceutical compositions may be formulated for co-administration or sequential administration with one or more additional active agents that can be used to treat cancer or an infectious disease (e.g., HIV or a Zika infection). For instance, administration of an additional therapeutic agent may be prior to, concurrent with, or subsequent to the administration of the compositions described herein.

Pharmaceutical compositions may also be used in combination with one or more antibiotics that can be administered to a patient (e.g., a human patient) suffering from an infectious disease. For instance, pharmaceutical compositions containing one or more of the recombinant RhAd vectors described herein (e.g., vectors encoding a portion or all of any one of RhAd54-RhAd67, or variants thereof, as described herein) may be admixed with or administered separately from an antibiotic useful for treating one or more infectious diseases, such as amikacin, gentamicin, kanamycin, neomycin, netilmicin, tobramycin, paromomycin, streptomycin, spectinomycin, geldanamycin, herbimycin, rifaximin, loracarbef, ertapenem, doripenem, imipenem, meropenem, cefadroxil, cefazolin, cefazlexin, cefaclor, cefoxitin, cefprozil, cefuroxime, cefdinir, cefditoren, cefoperazone, clindamycin, lincomycin, daptomycin, erythromycin, linezolid, torezolid, amoxicillin, ampicillin, bacitracin, ciprofloxacin, doxycycline, and tetracycline, among others.

The compositions (e.g., vaccines, vectors, stabilized trimer(s), nucleic acids, or other composition thereof described herein) of the invention can be administered in combination with one or more additional therapeutic agents, for example, for treating an HIV infection (e.g., an HIV-1 infection) in a subject. Such additional therapeutic agents can include, for example, a broadly neutralizing antibody (bnAb), e.g., those described in PCT Application No. PCT/US14/58383, WO 2012/030904, and WO 2013/055908, each of which is incorporated by reference herein in its entirety.

Exemplary bnAbs that can be administered in combination with the compositions of the invention include PGT121, PGT122, PGT123, PGT124, PGT125, PGT126, PGT127, PGT128, PGT130, PGT131, PGT132, PGT133, PGT134, PGT135, PGT136, PGT137, PGT138, PGT139, PGT141, PGT142, PGT143, PGT144, PGT145, PGT151, PGT152, PGT153, PGT154, PGT155, PGT156, PGT157, PGT158, 10-1074, a derivative or clonal relative thereof, or a combination thereof. Further bnAbs that can administered in combination with the compositions of the invention include, for example, a CD4 binding site (CD4bs)-specific antibody (e.g., 3BNC117 or VRC07-523) or a V2 glycan-dependent antibody (e.g., CAP256-VRC26).

The additional therapeutic agent can also be an antiretroviral therapy (ART), which may, e.g., be selected from any one or more of the following, or combinations thereof: efavirenz, emtricitabine, and tenofovir disoproxil fumarate (Atripla); emtricitabine, rilpivirine, and tenofovir disoproxil fumarate (Complera); elvitegravir, cobicistat, emtricitabine, and tenofovir disoproxil fumarate (Stribild); lamivudine and zidovudine (Combivir); emtricitabine, FTC (Emtriva); lamivudine, 3TC (Epivir); abacavir and lamivudine (Ebzicom); zalcitabine, dideoxycytidine, ddC (Hivid); zidovudine, azidothymidine, AZT, ZDV (Retrovir); abacavir, zidovudine, and lamivudine (Trizivir); tenofovir disoproxil fumarate and emtricitabine (Truvada); enteric coated didanosine, ddI EC (Videx EC); didanosine, dideoxyinosine, ddI (Videx); tenofovir disoproxil fumarate, TDF (Viread); stavudine, d4T (Zerit); abacavir sulfate, ABC (Ziagen); Rilpivirine (Edurant); Etravirine (Intelence); delavirdine, DLV (Rescriptor); efavirenz, EFV (Sustiva); nevirapine, NVP (Viramune or Viramune XR); amprenavir, APV (Agenerase); tipranavir, TPV (Aptivus); indinavir, IDV (Crixivan); saquinavir (Fortovase); saquinavir mesylate, SQV (Invirase); lopinavir and ritonavir, LPV/RTV (Kaletra); Fosamprenavir Calcium, FOS-APV (Lexiva); ritonavir, RTV (Norvir); Darunavir (Prezista); atazanavir sulfate, ATV (Reyataz); nelfinavir mesylate, NFV (Viracept); enfuvirtide, T-20 (Fuzeon); maraviroc (Selzentry); raltegravir, RAL (Isentress); and dolutegravir (Tivicay).

The additional therapeutic agent can also be an immunomodulator. The immunomodulator may, e.g., be selected from any one or more of the following, or combinations thereof: AS-101, Bropirimine, Acemannan, CL246,738, EL10, FP-21399, Gamma Interferon, Granulocyte Macrophage Colony Stimulating Factor, HIV Core Particle Immunostimulant, IL-2, Immune Globulin Intravenous, IMREG-1, IMREG-2, Imuthiol Diethyl Dithio Carbamate, Alpha-2 Interferon, Methionine-Enkephalin, MTP-PE Muramyl-Tripeptide, Granulocyte Colony Stimulating Factor, Remune, CD4 (e.g., recombinant soluble CD4), rCD4-IgG hybrids, SK&F106528 Soluble T4, Thymopentin, Tumor Necrosis Factor, and Infliximab.

The additional therapeutic agent can also be a reservoir activator. The reservoir activator may, e.g., be selected from any one or more of the following, or combinations thereof: histone deacytelase (HDAC) inhibitors (e.g., romidepsin, vorinostat, and panobinostat), immunologic activators (e.g., cytokines and TLR agonists (e.g., TLR7 agonist, such as GS-986), and dedicated small molecule drugs.

Additionally or alternatively, a recombinant adenovirus described herein may be administered with or administered separately from, a chemotherapy agent, for example, for the treatment of cancer, such as a cancer described herein. Exemplary chemotherapy agents useful in conjunction with the compositions and methods of the invention include, without limitation, Abiraterone Acetate, ABITREXATE® (Methotrexate), ABRAXANE® (Paclitaxel Albumin), ADRIAMYCIN®, bleomycin, vinblastine, and dacarbazine (ABVD), ADRIAMYCIN®, bleomycin, vincristine sulfate, and etoposide phosphate (ABVE), ADRIAMYCIN®, bleomycin, vincristine sulfate, etoposide phosphate, prednisone, and cyclophosphamide (ABVE-PC), doxorubicin and cyclophosphamide (AC), doxorubicin, cyclophosphamide, and paclitaxel or docetaxel (AC-T), ADCETRIS® (Brentuximab Vedotin), cytarabine, daunorubicin, and etoposide (ADE), ado-trastuzumab emtansine, ADRIAMYCIN® (doxorubicin hydrochloride), afatinib dimaleate, AFINITOR® (Everolimus), AKYNZEO® (netupitant and palonosetron hydrochloride), ALDARA® (imiquimod), aldesleukin, ALECENSA® (alectinib), alectinib, alemtuzumab, ALKERAN® for Injection (Melphalan Hydrochloride), ALKERAN® tablets (melphalan), ALIMTA® (pemetrexed disodium), ALOXI® (palonosetron hydrochloride), AMBOCHLORIN® (chlorambucil), AMBOCLORIN® (Chlorambucil), aminolevulinic acid, anastrozole, aprepitant, AREDIA® (pamidronate disodium), ARIMIDEX® (anastrozole), AROMASIN® (exemestane), ARRANON® (nelarabine), arsenic trioxide, ARZERRA® (ofatumumab), asparaginase Erwinia chrysanthemi, AVASTIN® (bevacizumab), axitinib, azacitidine, BEACOPP Becenum (carmustine), BELEODAQ® (Belinostat), belinostat, bendamustine hydrochloride, bleomycin, etoposide, and cisplatin (BEP), bevacizumab, bexarotene, BEXXAR® (tositumomab and iodine $^{131}$I tositumomab), bicalutamide, BiCNU (carmustine), bleomycin, blinatumomab, BLINCYTO® (blinatumomab), bortezomib, BOSULIF® (bosutinib), bosutinib, brentuximab vedotin, busulfan, BUSULFEX® (busulfan), cabazitaxel, cabozantinib-S-malate, CAF, CAMPATH® (alemtuzumab), CAMPTOSAR® (irinotecan hydrochloride), capecitabine, CAPDX, CARAC® (fluorouracil), carboplatin, CARBOPLATIN-TAXOL®, carfilzomib, CARMUBRIS® (carmustine), carmustine, carmustine implant, CASODEX® (bicalutamide), CEENU (lomustine), cisplatin, etoposide, and methotrexate (CEM), ceritinib, CERUBIDINE® (daunorubicin hydrochloride), CERVARIX® (recombinant HPV bivalent vaccine), cetuximab, chlorambucil, chlorambucil-prednisone, CHOP, cisplatin, CLAFEN® (cyclophosphamide), clofarabine, CLOFAREX® (clofarabine), CLOLAR® (Clofarabine), CMF, cobimetinib, cometriq (cabozantinib-S-malate), COPDAC, COPP, COPP-ABV, COSMEGEN® (dactinomycin), COTELLIC® (cobimetinib), crizotinib, CVP, cyclophosphamide, CYFOS® (ifosfamide), CYRAMZA® (ramucirumab), cytarabine, cytarabine liposome, CYTOSAR-U® (cytarabine), CYTOXAN® (cyclophosphamide), dabrafenib, dacarbazine, DACOGEN® (decitabine), dactinomycin, daratumumab, DARZALEX® (daratumumab), dasatinib, daunorubicin hydrochloride, decitabine, degarelix, denileukin diftitox, denosumab, DEPOCYT® (cytarabine liposome), dexamethasone, dexrazoxane hydrochloride, dinutuximab, docetaxel, DOXIL® (doxorubicin hydrochloride), doxorubicin hydrochloride, DOX-SL® (doxorubicin hydrochloride), DTIC-DOME® (dacarbazine), EFUDEX (fluorouracil), ELITEK® (rasburicase), ELLENCE® (epirubicin hydrochloride), elotuzumab, ELOXATIN® (oxaliplatin), eltrombopag olamine, EMEND® (aprepitant), EMPLICITI® (elotuzumab), enzalutamide, epirubicin hydrochloride, EPOCH, ERBITUX® (cetuximab), eribulin mesylate, ERIVEDGE® (vismodegib), erlotinib hydrochloride, ERWINAZE® (asparaginase *Erwinia chrysanthemi*), ETOPOPHOS® (etoposide phosphate), etoposide, etoposide phosphate, EVACET® (doxorubicin hydrochloride liposome), everolimus, EVISTA® (raloxifene hydrochloride), EVOMELA® (melphalan hydrochloride), exemestane, 5-FU (5-fluorouracil), FARESTON® (toremifene), FARYDAK® (panobinostat), FASLODEX® (fulvestrant), FEC, FEMARA® (letrozole), filgrastim, FLUDARA® (fludarabine phosphate), fludarabine phosphate, FLUOROPLEX® (fluorouracil), fluorouracil injection, flutamide, FOLEX® (methotrexate), FOLEX® PFS (methotrexate), FOLFIRI, FOLFIRI-bevacizumab, FOLFIRI-cetuximab, FOLFIRINOX, FOLFOX, FOLOTYN® (pralatrexate), FU-LV, fulvestrant, GARDASIL® (recombinant HPV quadrivalent vaccine), GARDASIL 9® (recombinant HPV nonavalent vaccine), GAZYVA® (obinutuzumab), gefitinib, gemcitabine hydrochloride, gemcitabine-cisplatin, gemcitabine-oxaliplatin, gemtuzumab ozogamicin, GEMZAR® (gemcitabine hydrochloride), GILOTRIF® (afatinib dimaleate), GLEEVEC® (imatinib mesylate), GLIADEL® (carmustine implant), GLIADEL® wafer (carmustine implant), glucarpidase, goserelin acetate, HALAVEN® (eribulin mesylate), HERCEPTIN® (trastuzumab), HPV bivalent vaccine, HYCAMTIN® (topotecan hydrochloride), Hyper-CVAD, IBRANCE (palbociclib), IBRITUMOMAB® tiuxetan, ibrutinib, ICE, ICLUSIG® (ponatinib hydrochloride), IDAMYCIN® (idarubicin hydrochloride), idarubicin hydrochloride, idelalisib, IFEX® (ifosfamide), ifosfamide, ifosfamidum, IL-2 (aldesleukin), imatinib mesylate, IMBRUVICA® (ibrutinib), ilmiquimod, IMLYGIC® (talimogene laherparepvec), INLYTA (axitinib), recombinant interferon alpha-2b, intron A, tositumomab, such as $^{131}$I tositumomab, ipilimumab, IRESSA® (gefitinib), irinotecan hydrochloride, ISTODAX® (romidepsin), ixabepilone, ixazomib citrate, IXEMPRA® (ixabepilone), JAKAFI® (ruxolitinib phosphate), JEVTANA® (cabazitaxel), KADCYLA® (ado-trastuzumab emtansine), KEOXIFENE® (raloxifene hydrochloride), KEPIVANCE® (palifermin), KEYTRUDA® (pembrolizumab), KYPROLIS® (carfilzomib), lanreotide acetate, lapatinib ditosylate, lenalidomide, lenvatinib mesylate, LENVIMA® (lenvatinib mesylate), letrozole, leucovorin calcium, leukeran (chlorambucil), leuprolide acetate, levulan (aminolevulinic acid), LINFOLIZIN® (chlorambucil), LIPODOX® (doxorubicin hydrochloride liposome), lomustine, LONSURF® (trifluridine and tipiracil hydrochloride), LUPRON® (leuprolide acetate), LYNPARZA® (olaparib), MARQIBO® (vincristine sulfate liposome), MATULANE® (procarbazine hydrochloride), mechlorethamine hydrochloride, megestrol acetate, MEKINIST® (trametinib), melphalan, melphalan hydrochloride, mercaptopurine, MESNEX® (mesna), METHAZOLASTONE® (temozolomide), methotrexate, methotrexate LPF, MEXATE® (methotrexate), MEXATE-AQ® (methotrexate), mitomycin C, mitoxantrone hydrochloride, MITOZYTREX® (mitomycin C), MOPP, MOZOBIL® (plerixafor), MUSTARGEN® (mechlorethamine hydrochloride), MUTAMYCIN® (mitomycin C), MYLERAN® (busulfan), MYLOSAR® (azacitidine), MYLOTARG® (gemtuzumab ozogamicin), nanoparticle paclitaxel, NAVELBINE® (vinorelbine tartrate), NECITUMUMAB, nelarabine, NEOSAR® (cyclophosphamide), netupitant and palonosetron hydrochloride, NEUPOGEN® (filgrastim), NEXAVAR® (sorafenib tosylate), NILOTINIB, NINLARO® (ixazomib citrate), nivolumab, NOLVADEX® (tamoxifen citrate), NPLATE® (romiplostim), obinutuzumab, ODOMZO® (sonidegib), OEPA, ofatumumab, OFF, olaparib, omacetaxine mepesuccinate, ONCASPAR® (pegaspargase), ondansetron hydrochloride, ONIVYDE® (irinotecan hydrochloride liposome), ONTAK® (denileukin diftitox), OPDIVO® (nivolumab), OPPA, osimertinib, oxaliplatin, paclitaxel, paclitaxel albumin-stabilized nanoparticle formulation, PAD, palbociclib, palifermin, palonosetron hydrochloride, palonosetron hydrochloride and netupitant, pamidronate disodium, panitumumab, panobinostat, PARAPLAT® (carboplatin), PARPLATIN® (carboplatin), pazopanib hydrochloride, PCV, pegaspargase, peginterferon alpha-2b, PEG-INTRON® (peginterferon alpha-2b), pembrolizumab, pemetrexed disodium, PERJETA® (pertuzumab), pertuzumab, PLATINOL® (cisplatin), PLATINOL-AQ® (cisplatin), plerixafor, pomalidomide, POMALYST® (pomalidomide), ponatinib hydrochloride, PORTRAZZA® (necitumumab), pralatrexate, prednisone, procarbazine hydrochloride, PROLEUKIN® (aldesleukin), PROLIA® (denosumab), PROMACTA (eltrombopag olamine), PROVENGE® (sipuleucel-T), PURINETHOL® (mercaptopurine), PURIXAN® (mercaptopurine), $^{223}$Ra dichloride, raloxifene hydrochloride, ramucirumab, rasburicase, R-CHOP, R-CVP, recombinant human papillomavirus (HPV), recombinant interferon alpha-2b, regorafenib, R-EPOCH, REVLIMID® (lenalidomide), RHEUMATREX® (methotrexate), RITUXAN® (rituximab), rolapitant hydrochloride, romidepsin, romiplostim, rubidomycin (daunorubicin hydrochloride), ruxolitinib phosphate, SCLEROSOL® intrapleural aerosol (talc), siltuximab, sipuleucel-T, somatuline depot (lanreotide acetate), sonidegib, sorafenib tosylate, SPRYCEL® (dasatinib), STANFORD V, sterile talc powder (talc), STERITALC® (talc), STIVARGA® (regorafenib), sunitinib malate, SUTENT® (sunitinib malate), SYLATRON® (peginterferon alpha-2b), SYLVANT® (siltuximab), SYNOVIR® (thalidomide), SYNRIBO® (omacetaxine mepesuccinate), thioguanine, TAC, TAFINLAR® (dabrafenib), TAGRISSO® (osimertinib), talimogene laherparepvec, tamoxifen citrate, tarabine PFS (cytarabine), TARCEVA (erlotinib hydrochloride), TARGRETIN® (bexarotene), TASIGNA® (nilotinib), TAXOL® (paclitaxel), TAXOTERE® (docetaxel), TEMODAR® (temozolomide), temsirolimus, thalidomide, THALOMID® (thalidomide), thioguanine, thiotepa, TOLAK® (topical fluorouracil), topotecan hydrochloride, toremifene, TORISEL® (temsirolimus), TOTECT® (dexrazoxane hydrochloride), TPF, trabectedin, trametinib, TREANDA® (bendamustine hydrochloride), trifluridine and tipiracil hydrochloride, TRISENOX® (arsenic trioxide), TYKERB® (lapatinib ditosylate), UNITUXIN® (dinutuximab), uridine triacetate, VAC, vandetanib, VAMP, VARUBI® (rolapitant hydrochloride), vectibix (panitumumab), VeIP, VELBAN® (vinblastine sulfate), VELCADE® (bortezomib), VELSAR (vinblastine sulfate), VEMURAFENIB, VIADUR (leuprolide acetate), VIDAZA (azacitidine), vinblastine sulfate, VINCASAR® PFS (vincristine sulfate), vincristine sulfate, vinorelbine tartrate, VIP, vismodegib, VISTOGARD® (uridine triacetate), VORAXAZE® (glucarpidase), vorinostat, VOTRIENT® (pazopanib hydrochloride), WELLCOVORIN® (leucovorin calcium), XALKORI® (crizotinib), XELODA® (capecitabine), XELIRI, XELOX, XGEVA® (denosumab), XOFIGO® ($^{223}$Ra dichloride), XTANDI® (enzalutamide), YERVOY® (ipilimumab), YONDELIS® (trabectedin), ZALTRAP® (ziv-aflibercept), ZARXIO® (filgrastim), ZELBORAF® (vemurafenib), ZEVALIN® (ibritumomab tiuxetan), ZINECARD® (dexrazoxane hydrochloride), ziv-aflibercept, ZOFRAN® (ondansetron hydrochloride), ZOLADEX® (gGoserelin acetate), zoledronic acid, ZOLINZA® (vorinostat), ZOMETA® (zoledronic acid), ZYDELIG® (idelalisib), ZYKADIA® (ceritinib), and ZYTIGA (abiraterone acetate).

Methods of Production

Also featured herein are methods of producing a recombinant adenovirus or a vector described herein. To produce recombinant adenoviruses or vectors, a cell can be transfected with an isolated polynucleotide described herein or a complement thereof. Cells that can be transfected include bacterial cells, plant cells, or mammalian cells. For example, the transfected cell may be a Chinese hamster overy (CHO) cell, or other cell types known in the art. Following transfection, the cell may be cultured in a suitable medium to allow replication of the polynucleotide or the vector in said cell and the recombinant adenovirus or vector may be harvested from the cell and/or from the medium for use in accordance with any of the methods described herein. Methods of transfecting plasmids (and cosmids) are well known in the art. Moreover, suitable medium for packaging cells have also been described in the art and are not elaborated on herein. Harvesting methods are also known to the skilled person. Methods for producing recombinant adenoviruses, suitable cell lines for recombinant vector production, and transfection methods are known in the art (See, e.g., U.S. Pat. No. 8,394,386, incorporated herein by reference).

Kits

Also featured herein are kits that include a pharmaceutical composition, vector (e.g., vectors encoding a portion or all of any one of RhAd54-RhAd67, or variants thereof, as described herein), or an adenovirus (RhAd54-RhAd67, or variants thereof, as described herein), and, e.g., a pharmaceutically-acceptable carrier, in a therapeutically effective amount for preventing or treating a disease (e.g., an infectious disease described herein (e.g., HIV infection or a Zika infection) or a cancer described herein). The kits can include instructions directing a clinician (e.g., a physician or nurse) in methods for administering the composition contained therein.

The kits may include multiple packages of single-dose pharmaceutical composition(s) containing an effective amount of a composition, vaccine, vector, nucleic acid molecule, polypeptide, or cell of the invention. Optionally, instruments or devices necessary for administering the pharmaceutical composition(s) may be included in the kits. For instance, a kit of this invention may provide one or more pre-filled syringes containing an effective amount of a vector described herein (e.g., vectors encoding a portion or all of any one of RhAd54-RhAd67, or variants thereof, as described herein). Furthermore, the kits may also include additional components, such as instructions or schedules for administration of the composition to a patient infected with or at risk of being infected with an infective agent (e.g., a virus) or having a cancer.

It will be apparent to those skilled in the art that various modifications and variations can be made in the compositions, methods, and kits of the invention without departing from the spirit or scope of the invention. Thus, it is intended that the invention cover the modifications and variations of this invention provided they come within the scope of the appended claims and their equivalents.

EXAMPLES

The following examples are to illustrate the invention. They are not meant to limit the invention in any way.

The practice of this invention may employ, unless otherwise indicated, conventional techniques of molecular biology, cell biology, and recombinant DNA, which are within the skill of the person skilled in the art (see, e.g., Green and Sambrook. *Molecular Cloning: A Laboratory Manuel*, 4$^{th}$ edition, 2012; Ausubel, et al. *Current Protocols in Molecular Biology*, 1987; *Methods in Enzymology*. Academic Press, Inc.; and MacPherson et al. *PCR2: A Practical Approach*, 1995).

Example 1. Novel Rhesus Adenoviral Vaccine Vectors

Introduction

Recombinant adenovirus vaccine vectors are being explored as vaccine vectors for treating pathogens, such as HIV, TB, Zika, malaria, RSV, and Ebola, as well as for treating cancers. Adenovirus vectors with low global seroprevalence are desirable to avoid potential problems associated with baseline anti-vector immunity and to achieve optimal immune responses and dose control following vaccination. Rare human and chimpanzee adenoviruses are being explored as vaccine vectors, but due to their close phylogenetic proximity to common human serotypes, substantial seroprevalence is still detected in human populations, particularly in the developing world. With larger evolutionary distance, lower seroprevalence would be expected for rhesus monkey adenoviruses. Moreover, adenovirus species can induce distinct innate immune response profiles, and thus different adenovirus vectors may prove most suitable for specific target pathogens.

Various methods exist to clone and to vectorize new serotypes. All current methods rely on the rare availability of restriction enzyme sites in the large genome of adenovirus, and to date the most efficient protocol requires at least two months of complex cloning. With the advancement of new molecular techniques, we describe here a rapid method of constructing adenovirus vaccine vectors. This method is independent of restriction enzymes, requires far less starting material, and can be applied essentially to any adenovirus serotype.

We report here the construction and characterization of 14 rhesus adenovirus (RhAd) vectors that were all generated by Gibson assembly. This approach to the rapid development of Ad vaccine vectors, as well as the biological assessment of these RhAd vectors, substantially increases the available vectors for vaccination and gene therapy.

Methods

Virus isolation and vector construction. Rhesus adenoviruses were isolated from stool samples. Rhesus monkey stool samples were shown to contain adenovirus by metagenomics sequencing. E1 complementing cells were infected with filtered stool samples and monitored for adenoviral growth. Lysates were plaque purified twice, and single clones were expanded and purified by cesium chloride density centrifugation. Viral DNA was extracted by lysing purified virus with SDS and proteinase K treatment and was sequenced by 454 sequencing (Seqwright GE Healthcare, Houston, Tex.).

To clone vectors, the wild type genome was divided into two constructs. The first construct, the AdApter plasmid, contained the left ITR of the adenovirus genome with deletion of all E1 sequences and approximately 2.5 kb from pIX including transcriptional elements necessary for pIX expression (Havenga et al., *J Gen Virol.* 87(Pt 8): 2135-43, 2006). The E1 region was replaced by a transgene cassette, which contains a CMV promotor, multiple cloning site, and SV40 polyA tail. The second construct, the cosmid, contains the remainder of the adenovirus genome from the pIX to the end of the right ITR. In the cosmid, the E3 region was deleted, and the start at the pIX region created a 2.5 kb overlap with the AdApter plasmid that facilitated homologous recombination in transfected E1-complementing cells. FIGS. 8-45 show schematic maps of the plasmids used in, and generated by the cloning methods.

The AdApter and cosmid primers were designed to generate 4 or 6 DNA fragments respectively. All PCR fragments had a 20-30 bp overlap with its adjacent PCR fragment. The PCR samples were run on a 0.8% low-melting agarose gel and purified using the Gel DNA recovery kit (Zymo Research, CA). DNA was eluted in nuclease free water and concentration was determined using the NANODROP™ 2000 spectrophotometer (Thermo Scientific, MA). The PCR fragments were assembled together using the Gibson assembly master mix kit (NE Biolabs, MA) according to manufacturer's recommendation and transformed into DH10B T1 phage-resistant electro competent *E. coli* (Invitrogen, CA). Colonies were screened by restriction enzyme digests, and band patterns were analyzed by DNA agarose gel electrophoresis and Sanger sequencing (Harvard core facility, MA).

Vector growth. E1 complementing cell lines were transfected with linearized AdApter plasmid and cosmid (Gibson et al., *Nat Methods.* 6(5):343-5, 2009). Homologous recombination yielded full length, E1/E3 deleted adenovirus. Virus was plaque purified and expanded to a production followed by purification by cesium chloride density centrifugation. Purified virus was buffer exchanged into PBS with 5% v/v sucrose buffer, flash frozen and stored at −80° C. Infectivity of the purified virus was assessed by PFU assays, and intact transgene presence was confirmed by PCR and sequencing.

Phylogenetic analysis. DNA sequences for whole genome and hexon were aligned by Muscle using ClustalW (EMBL-EBI, Hinxton). Maximum Likelihood trees were generated using PhyML 3.1/3.0 aLRT with Substitution model HKY85 and Gblock alignment refinement (Phylogeny.fr; see FIGS. 1A and 1B). TreeDyn 198.3 was used for visualization.

Seroprevalence. Seroprevalence of the novel rhesus adenovirus vectors was assessed by luciferase-based virus neutralization assays (Sprangers et al., *J Clin Microbiol.* 41(11):5046-52, 2003). Briefly, 100 South African and 100 Rwandan serum samples as well as 107 naive rhesus monkey serum samples were tested. Human samples were obtained with informed consent, and seroprevalence studies were performed with Beth Israel Deaconess Medical Center IRB approval. Serum was serially diluted in a 96-well plate, with the exception that the last column served as maximum infectivity. Virus was added, which was followed by addition of A549 cells. The plates were incubated for 24 h before the medium was removed and 100 µl phosphate-buffered saline (PBS) and 100 µl Steady-Glo substrate (Promega, Wis.) were added to the wells. Luminescence was read on a Victor 3 multilabel counter (PerkinElmer, MA). The seroprevalence titer was determined to be the dilution of serum where 90% of the virus was neutralized in the presence of serum.

Adaptive immune responses. To assess the cellular immunogenicity of these rhesus monkey adenovirus vectors, C57BL/6 mice (n=8) were immunized once by the intramuscular (IM) route with $10^9$ or $10^8$ vp of vectors expressing simian immunodeficiency virus (SIV) mac239 Gag. SIV Gag-specific $CD8^+$ T lymphocytes were assessed at weekly intervals by major histocompatibility complex class I-restricted $D^b$/AL11 tetramer binding assays (Barouch et al., *J Immunol.* 172(10):6290-7, 2004). Further assessment was done using gamma interferon (IFN-γ) enzyme-linked immunosorbent spot (ELISPOT) assays with splenocytes from spleens harvested at day 28. Splenocytes were isolated and stimulated in vitro with a SIV mac239 Gag peptide pool, the $CD8^+$ T-lymphocyte epitopes AL11 (AAVKNWMTQTL) and KV9 (KSLYNTVCV), and the $CD4^+$ T-lymphocyte epitope DD13 (DRFYKSLRAEQTD) (Liu et al., *J Virol.* 80(24):11991-7, 2006). Results reflect those from at least two separate experiments.

Luminex and transcriptomics. C57BL/6 mice (n=5) were immunized once by the IM route with $10^{10}$ vp of vectors not expressing any transgenes. Six hours post immunization cytokine and chemokine responses in serum were quantified using the Milliplex Mouse Cytokine/Chemokine Premixed 32 Plex Kit (Millipore, Mass.). Results were normalized versus PBS immunized mice, $Log_2$ transformed and placed into a heatmap using R programming. Transcriptomic responses in iliac lymph nodes were also assessed. C57BL/6 mice (n=3) were immunized IM with $10^{10}$ vp of vectors not expressing any antigen. After 24 hours, both iliac lymph nodes were harvested and total RNA was extracted using the QIAcube HT with the RNAeasy 96 QIAcube HT kit (Qiagen). RNA was reverse transcribed using the high-capacity RNA-to-cDNA Kit (Applied Biosystems), and the concentration of the cDNA was measured on the nanodrop 8000 spectrophotometer (Thermo Scientific, MA). Mouse immune TaqMan RT-array plates (Applied Biosystems, CA) were run according to manufacturer's recommendation on the Quantstudio 6 fast well (Applied Biosystems). Using R programming, a heatmap of log 2 ΔΔCT values normalized to PBS immunized mice was generated in which only significant values were plotted. Correlation among all RhAd vectors was generated using the RT-Array results using ggplot and R programming and placed in a correlogram. Functional annotation of genes was assessed using MSigDB and GeneCard. All animal studies were approved by the Beth Israel Deaconess Medical Center Institutional Animal Care and Use Committee (IACUC).

Vector tropism. Tissue tropism was assessed by infection of RhAd-eGFP expressing vectors in the following cell lines: A549 (human lung carcinoma, ATCC), MK2 (Rhesus kidney, ATCC), ARPE-19 (Human retinal, ATCC), HuTu80 (Human duodenum, ATCC), Prostate (Human primary cells, ATCC) and Bladder (Human primary cells, ATCC). $10^5$ cells were seeded in a MW24 plate and incubated overnight at 37° C., 10% $CO_2$. The next day cells were infected (n=2) with 100 and 1000 MOI of adenovirus vectors and incubated overnight. After 24 hours, cells were harvested and fixed in 2% formaldehyde (Sigma) and run and analyzed on LRSII flow cytometer and FlowJo software v8 (BD Biosciences).

Assays were run a minimum of two times and percentage positive cells were plotted using Graphpad Prism® 7 (Graphpad).

Receptor use. To assess receptor use of these novel rhesus adenovirus vectors, we utilized HAP1 parental as well as CAR, CD46, CD55, and sialic acid knock out cell lines (Horizon). One day prior to infection, $10^5$ cells were seeded in a MW24 plate. The next day the cells were infected (n=2) with 1000 MOI of adenovirus vectors expressing eGFP for one hour. After one hour media was replaced with fresh media and the cells were incubated for 24 hours at which time the cells were harvested, fixed in 2% formaldehyde and analyzed by flow cytometry using an LSRII flow cytometer and FlowJo software v8 (BD Biosciences). Assays were run a minimum of two times. Results were normalized for 100% infection in the parental cell line and plotted using Graphpad prism 7 (Graphpad, CA).

Results

Figure 1B:
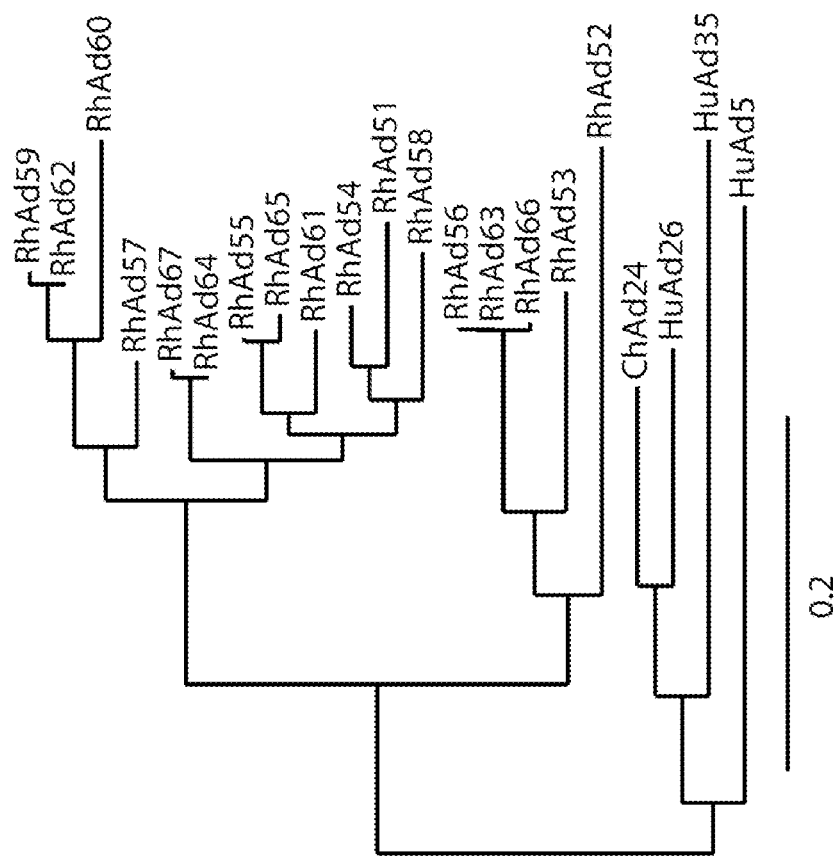
FIG. 1B is a schematic showing a maximum likelihood phylogenetic tree for rhesus, human, and chimpanzee adenovirus for hexon genes generated using PhyML 3.1/3.0 aLRT. DNA sequences were MUSCLE aligned and placed into a tree with TreeDyn 198.3. The tree is drawn to scale, with branch lengths measured in the number of substitutions per site.
Figure 1C:
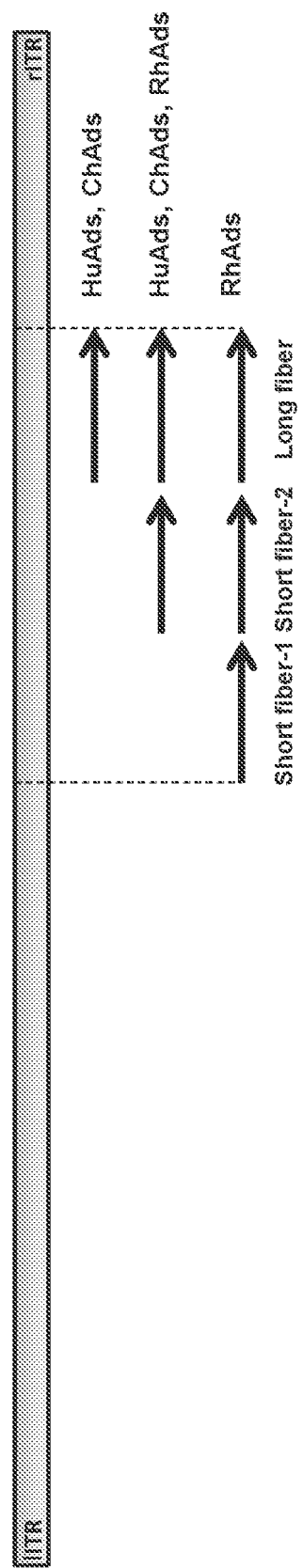
FIG. 1C is an image showing a schematic representation of placement of fiber genes in adenoviruses, not drawn to scale.
Figure 10:
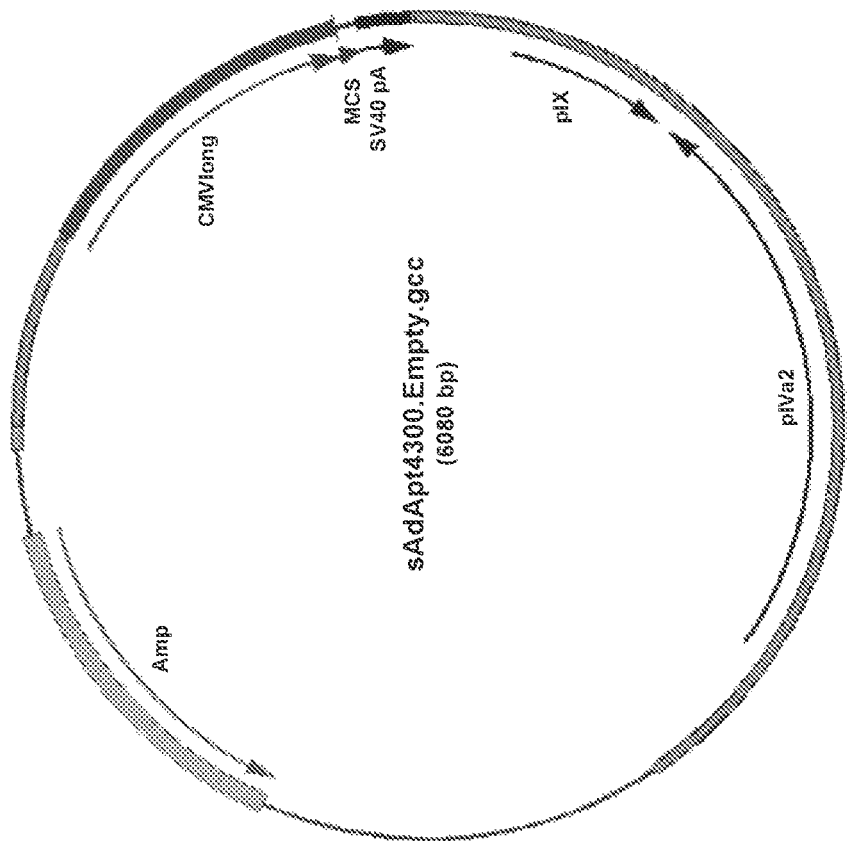
FIG. 10 is a schematic map of plasmid RhAdApt55. Empty (SEQ ID NO: 226), which contains the left ITR, an E1 deletion, a Transgene Cassette (CMV promoter, multiple cloning site, SV40 polyA), and approximately 2.5 kb of the RhAd55 genome starting before pIX.
Figure 11:
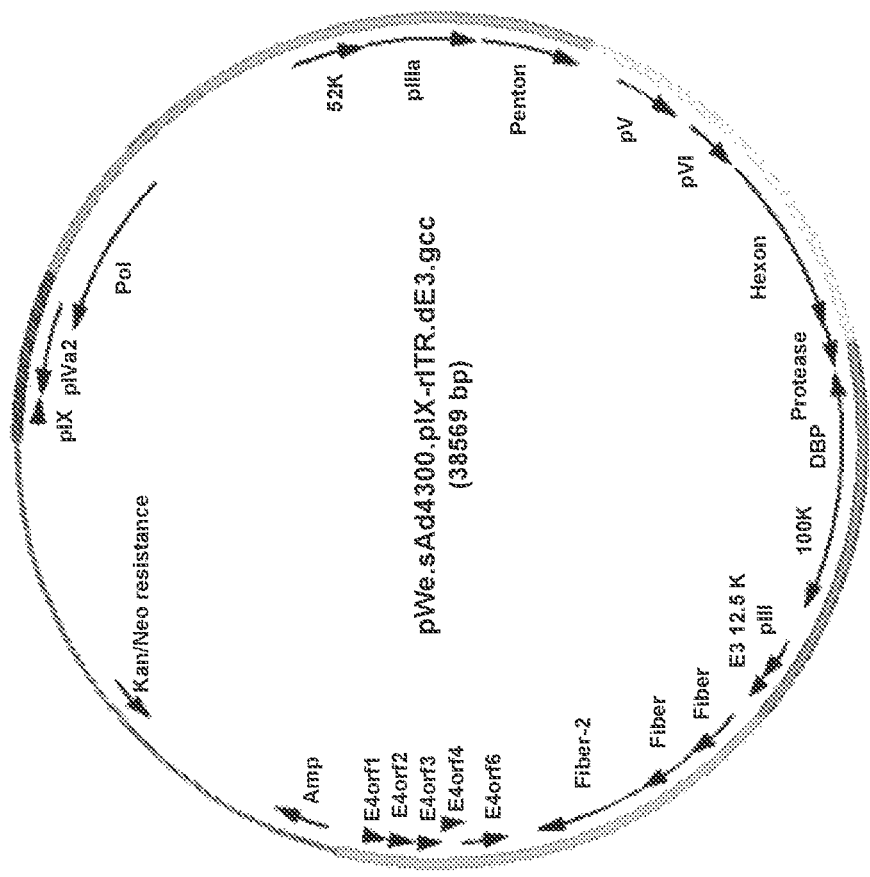
FIG. 11 is a schematic map of plasmid pWe/RhAd55.pIX-rITR.dE3 (SEQ ID NO: 227), which contains the remainder of the RhAd55 genome from pIX through rITR, but lacks the E3 region.
Figure 12:
FIG. 12 is a schematic map of plasmid RhAdApt56.Empty (SEQ ID NO: 228), which contains the left ITR, an E1 deletion, a Transgene Cassette (CMV promoter, multiple cloning site, SV40 polyA), and approximately 2.5 kb of the RhAd56 genome starting before pIX.
Figure 13:
FIG. 13 is a schematic map of plasmid RhAdApt56.v2.Empty (SEQ ID NO: 229), which contains the left ITR, an E1 deletion, a Transgene Cassette (CMV promoter, multiple cloning site, SV40 polyA), approximately 2.5 kb of the RhAd56 genome starting before pIX. The last remaining approximately 190 bp of E1 that were present before the pIX in RhAdApt. Empty have been deleted.
Figure 14:
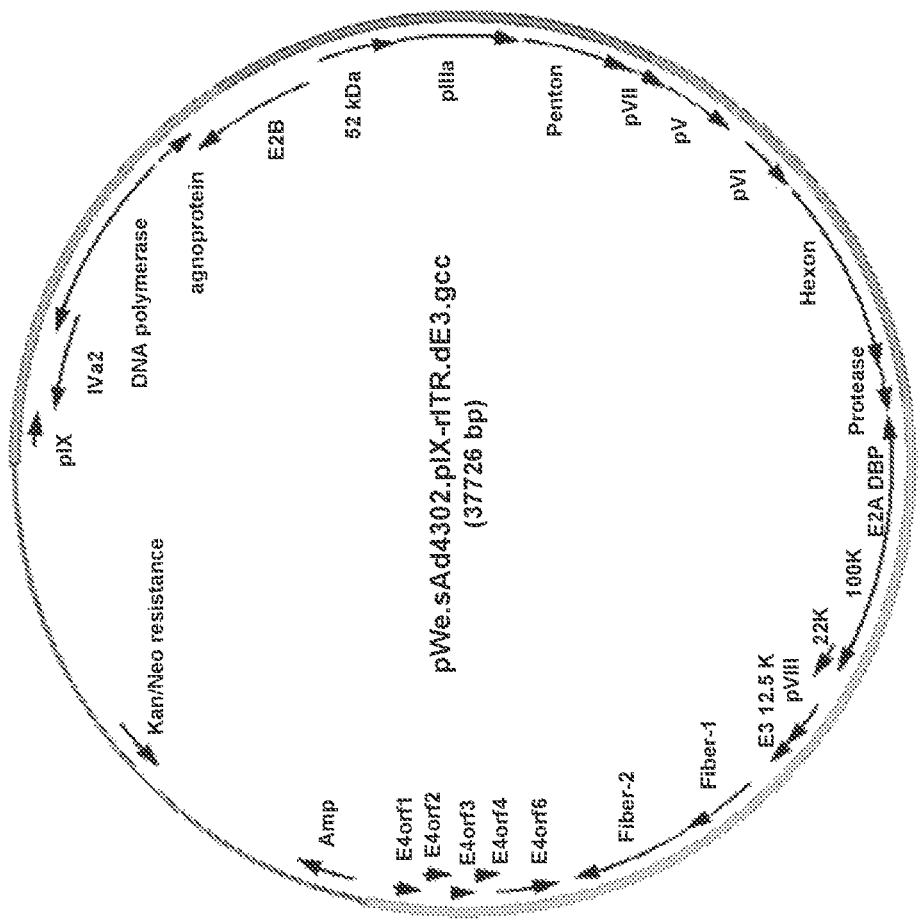
FIG. 14 is a schematic map of plasmid pWe/RhAd56.pIX-rITR.dE3 (SEQ ID NO: 230), which contains the remainder of the RhAd56 genome from pIX through rITR, but lacks the E3 region.
Figure 15:
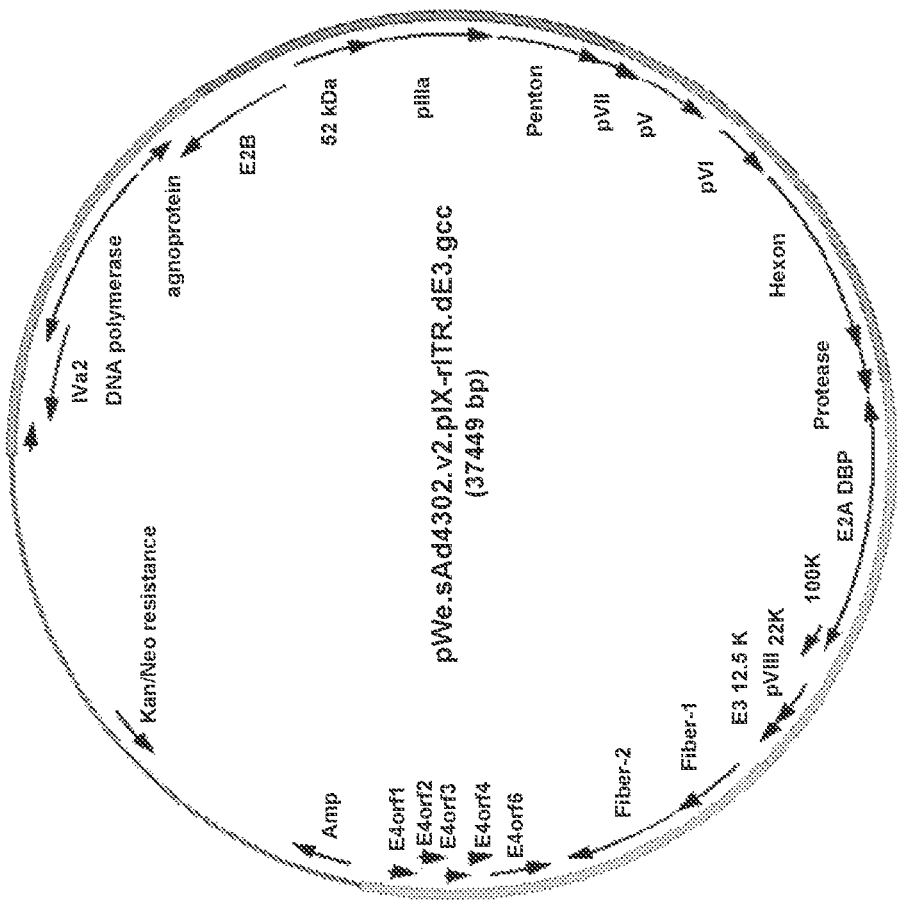
FIG. 15 is a schematic map of plasmid pWe/RhAd56.v2.pIX-rITR.dE3 (SEQ ID NO: 231), which contains the remainder of the RhAd56 genome from pIX through rITR but lacks the E3 region. The last remaining approximately 190 bp of E1 that were present before the pIX in pWe/RhAd.pIX-rITR.dE3 have been deleted.
Figure 16:
FIG. 16 is a schematic map of plasmid pWe/RhAd56.pIX-rITR.dE3.5orf6 (SEQ ID NO: 232), which contains the remainder of the RhAd56 genome from pIX through rITR, but lacks the E3 region. The E4orf6 has been swapped with the E4orf6 of HuAd5.
Figure 17:
FIG. 17 is a schematic map of plasmid RhAdApt57.Empty (SEQ ID NO: 234), which contains the left ITR, E1 deletion, Transgene Cassette (CMV promoter, multiple cloning site, SV40 polyA), and approximately 2.5 kb of the RhAd57 genome starting before pIX
Figure 18:
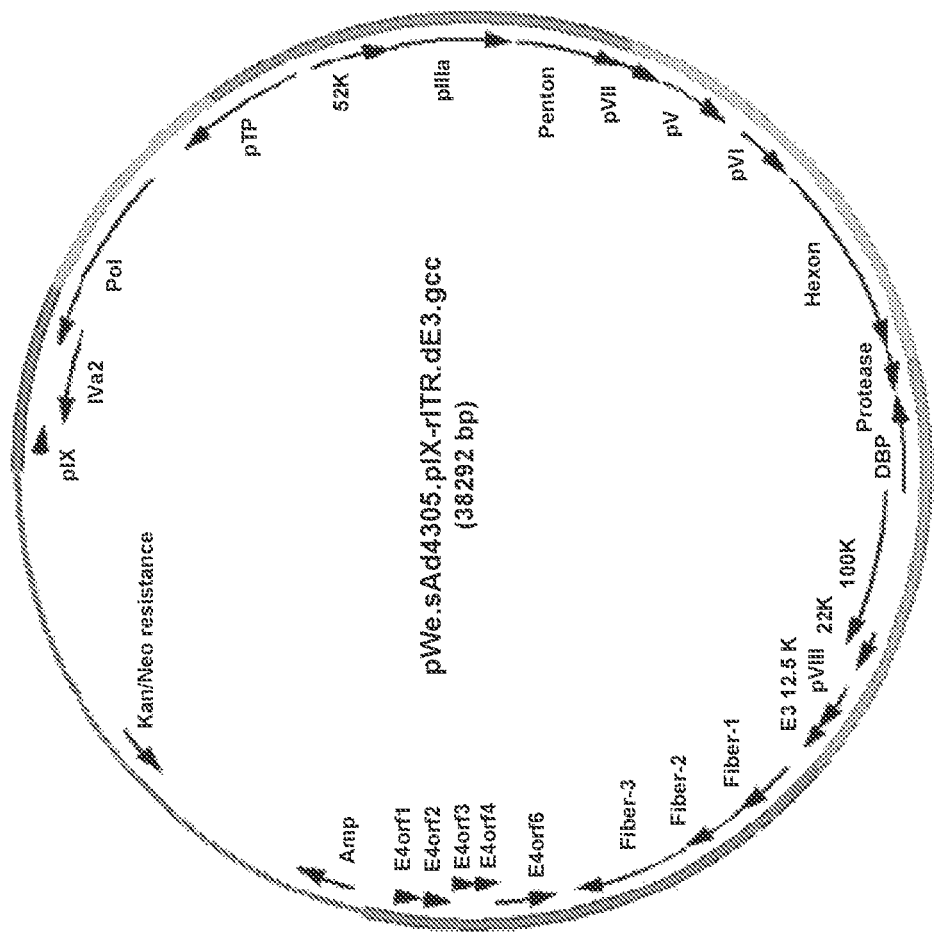
FIG. 18 is a schematic map of plasmid pWe/RhAd57.pIX-rITR.dE3 (SEQ ID NO: 235), which contains the remainder of RhAd genome from pIX through rITR, but lacks the E3 region.
Figure 19:
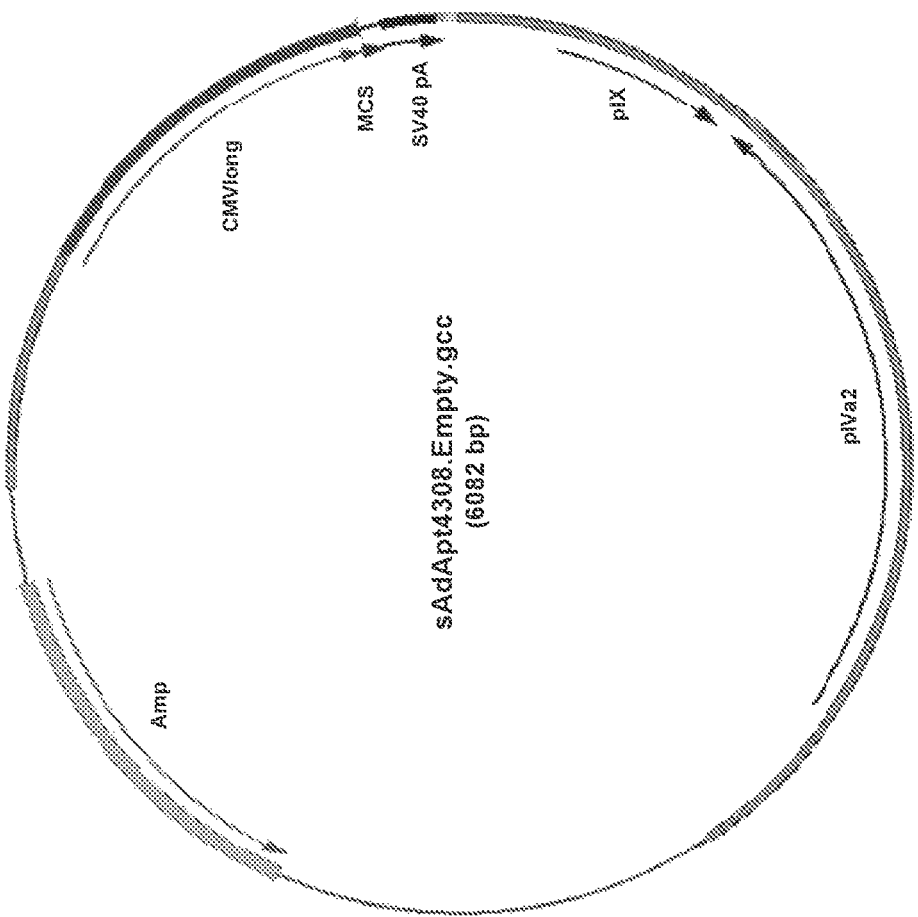
FIG. 19 is a schematic map of plasmid RhAdApt58.Empty (SEQ ID NO: 236), which contains the left ITR, an E1 deletion, Transgene Cassette (CMV promoter, multiple cloning site, SV40 polyA), and approximately 2.5 kb of the RhAd58 genome starting before pIX.
Figure 20:
FIG. 20 is a schematic map of plasmid RhAdApt58.v2.Empty (SEQ ID NO: 237), which contains the left ITR, an E1 deletion, Transgene Cassette (CMV promoter, multiple cloning site, SV40 polyA), approximately 2.5 kb of the RhAd58 genome starting before pIX. The last remaining ~190 bp of E1 that were present before the pIX in RhAdApt. Empty have been deleted.
Figure 21:
FIG. 21 is a schematic map of plasmid pWe/RhAd58.pIX-rITR.dE3 (SEQ ID NO: 238), which contains the remainder of the RhAd58 genome from pIX through rITR, but lacks the E3 region.
Figure 22:
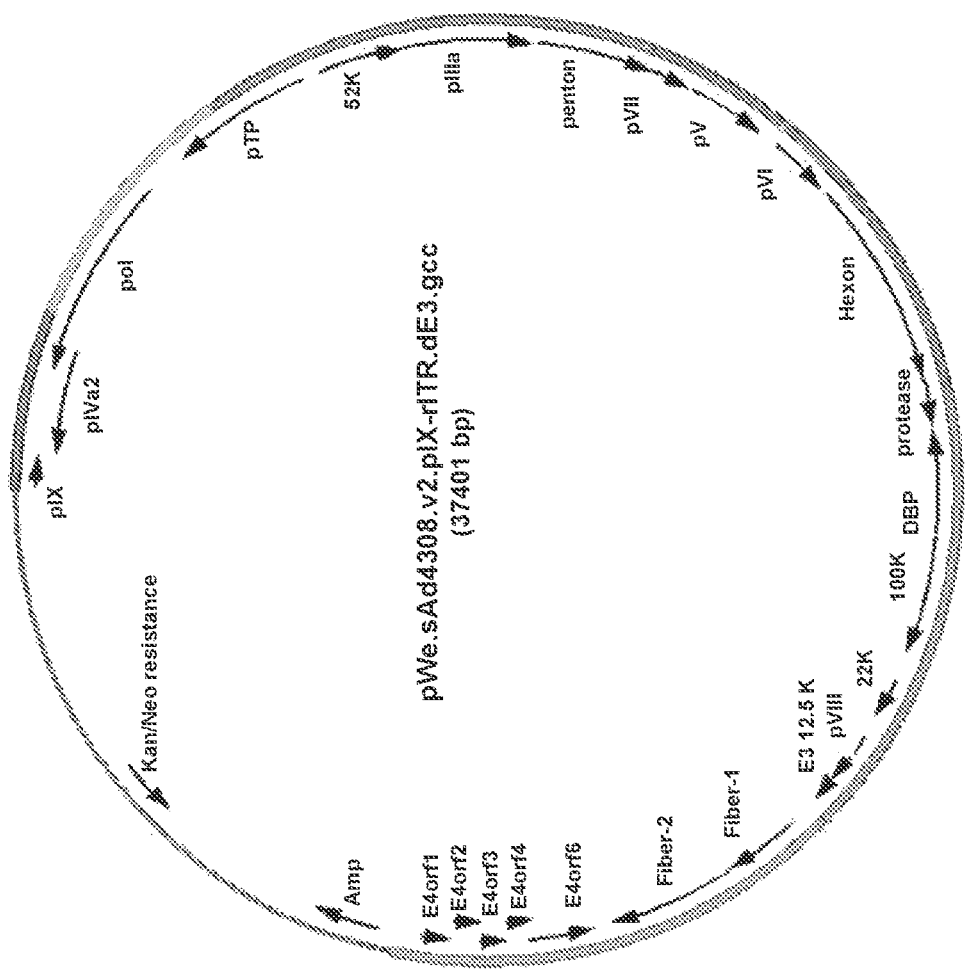
FIG. 22 is a schematic map of plasmid pWe/RhAd58.v2.pIX-rITR.dE3 (SEQ ID NO: 239), which contains the remainder of the RhAd58 genome from pIX through rITR but lacks the E3 region. The last remaining ~190 bp of E1 that were present before the pIX in pWe/RhAd.pIX-rITR.dE3 have been deleted.
Figure 23:
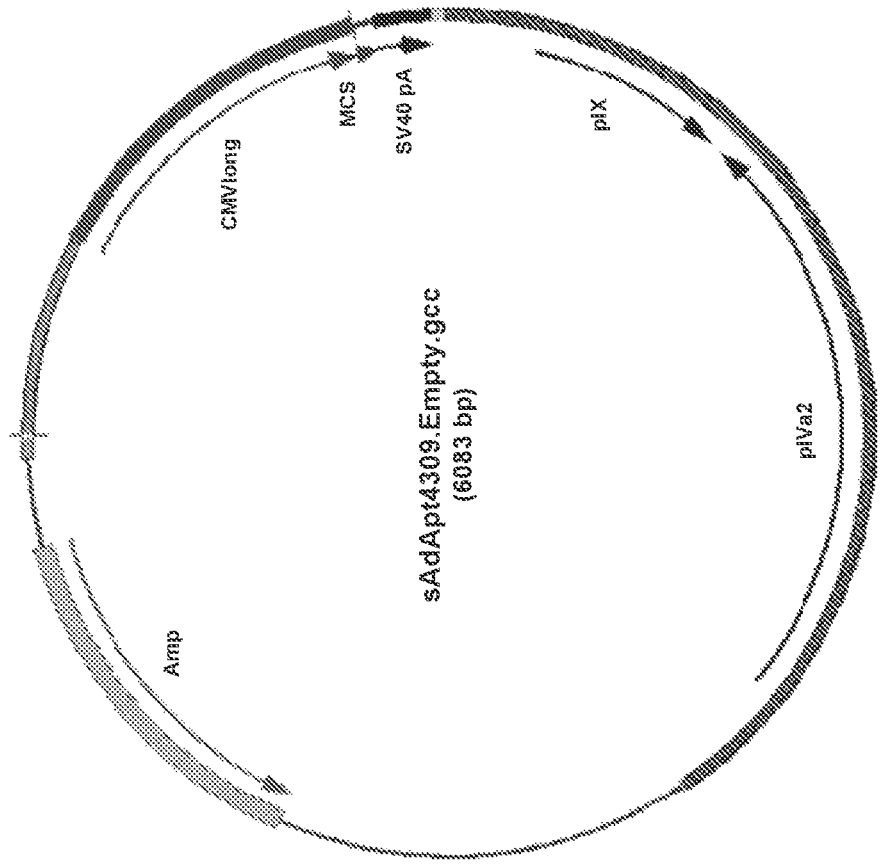
FIG. 23 is a schematic map of plasmid RhAdApt59.Empty (SEQ ID NO: 240), which contains the left ITR, an E1 deletion, Transgene Cassette (CMV promoter, multiple cloning site, SV40 polyA), and approximately 2.5 kb of the RhAd59 genome starting before pIX.
Figure 24:
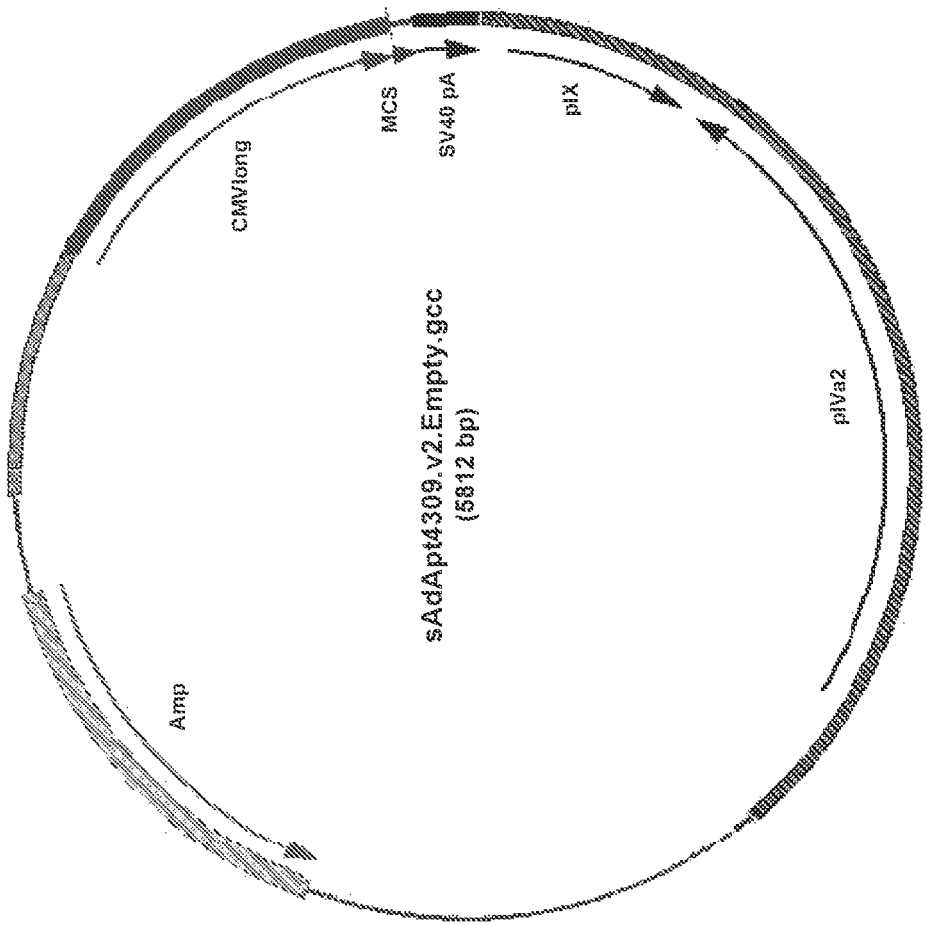
FIG. 24 is a schematic map of plasmid RhAdApt59.v2.Empty (SEQ ID NO: 241), which contains the left ITR, an E1 deletion, Transgene Cassette (CMV promoter, multiple cloning site, SV40 polyA), and approximately 2.5 kb of the RhAd59 genome starting before pIX. The last remaining ~190 bp of E1 that were present before the pIX in RhAdApt.Empty have been deleted.
Figure 25:
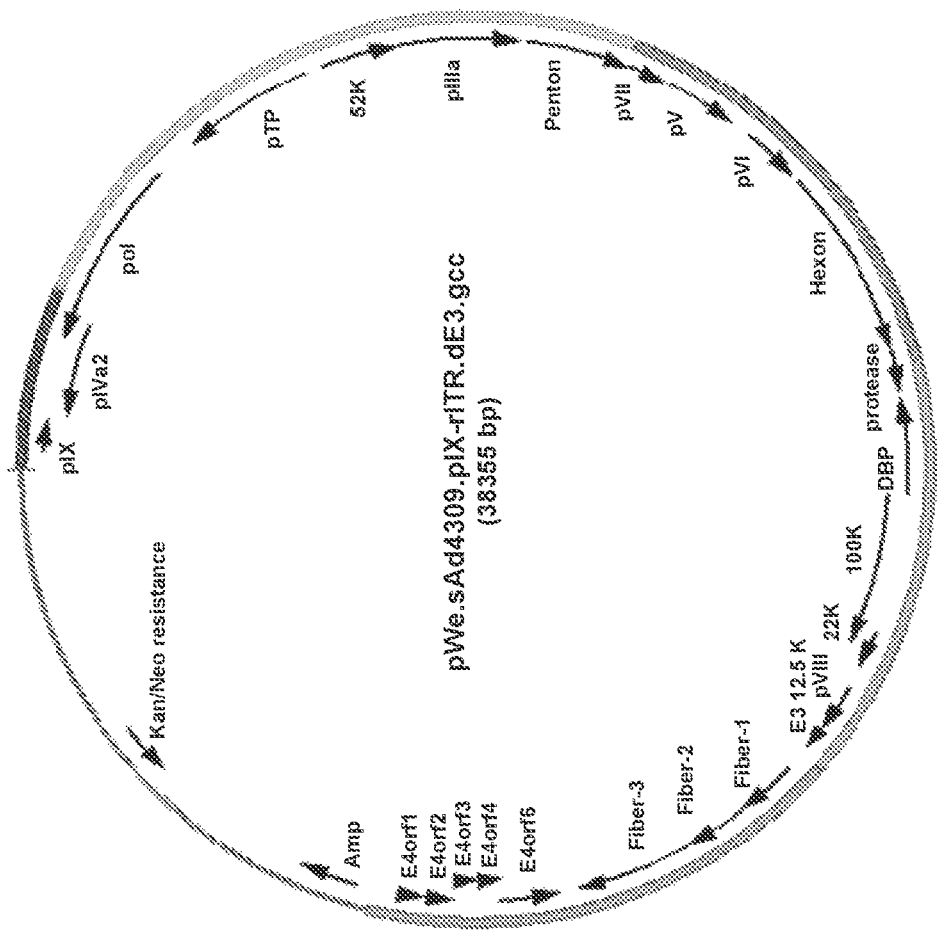
FIG. 25 is a schematic map of plasmid pWe/RhAd59.pIX-rITR.dE3 (SEQ ID NO: 242), which contains the remainder of the RhAd59 genome from pIX through rITR, but lacks the E3 region.
Figure 26:
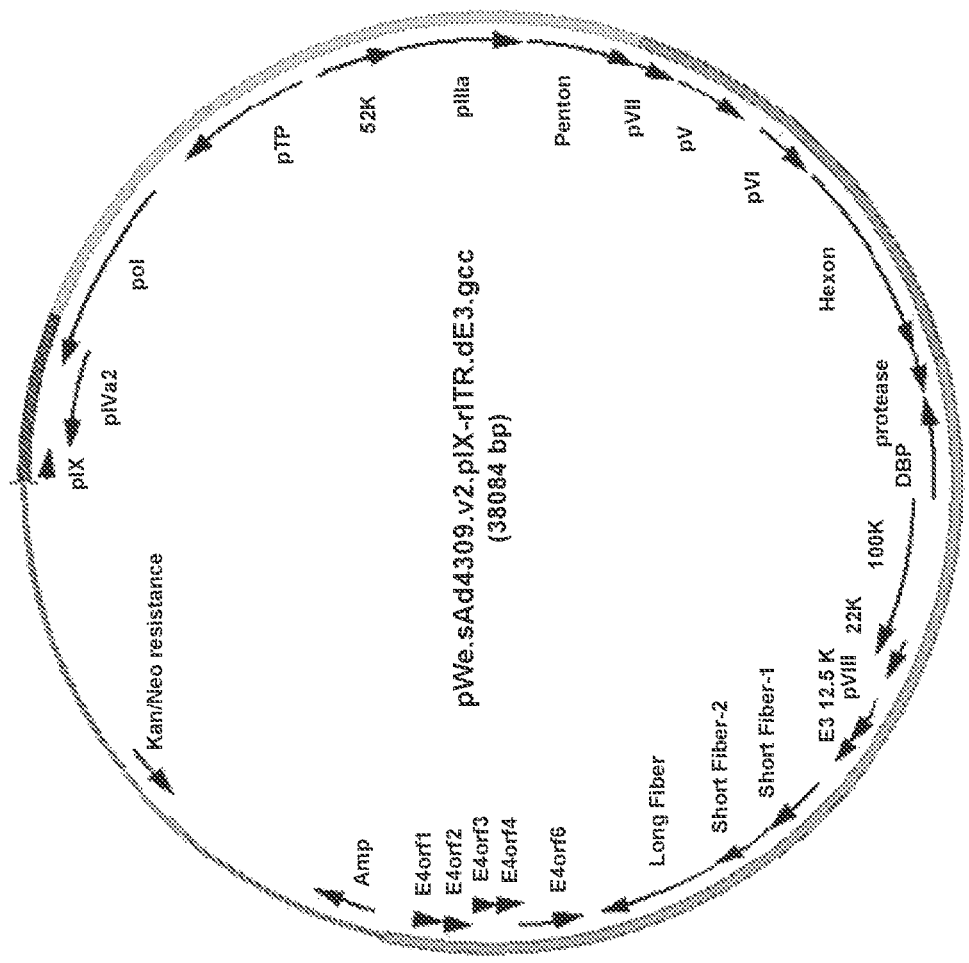
FIG. 26 is a schematic map of plasmid pWe/RhAd59.v2.pIX-rITR.dE3 (SEQ ID NO: 243), which contains the remainder of the RhAd59 genome from pIX through rITR but lacks the E3 region. The last remaining ~190 bp of E1 that were present before the pIX in pWe/RhAd.pIX-rITR.dE3 have been deleted.
Figure 27:
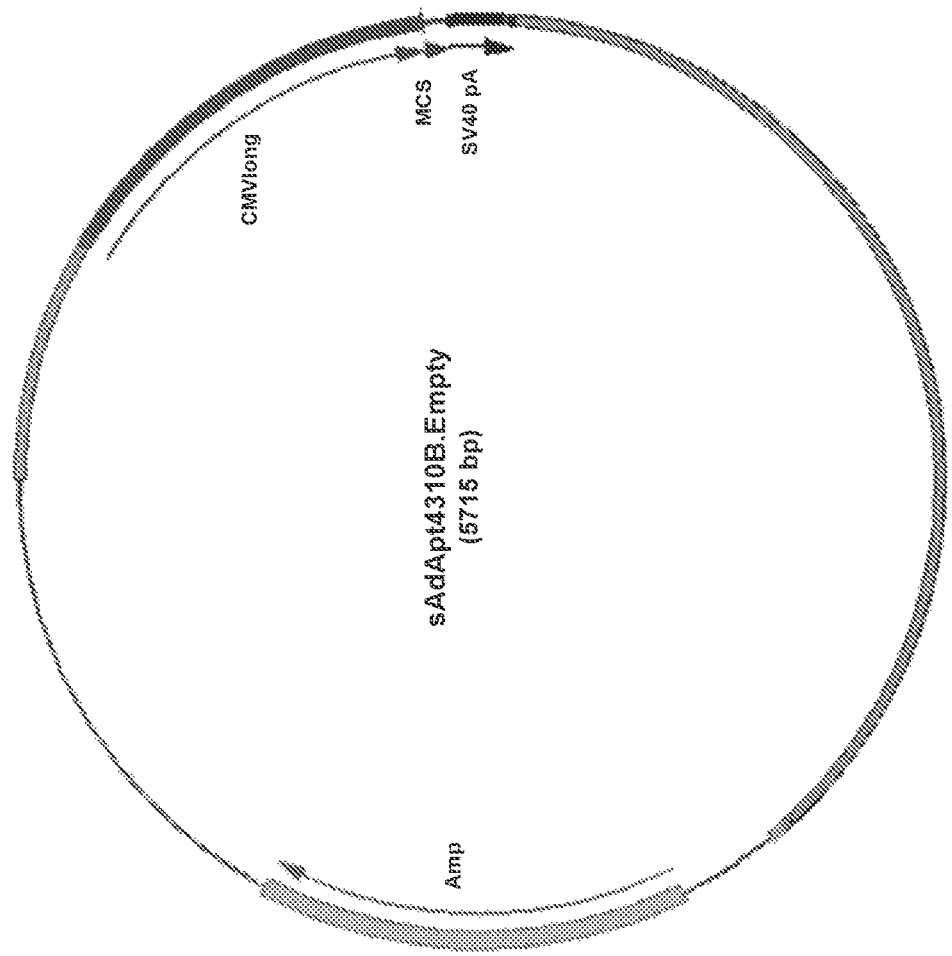
FIG. 27 is a schematic map of plasmid RhAdApt60.Empty (SEQ ID NO: 244), which contains the left ITR, an E1 deletion, Transgene Cassette (CMV promoter, multiple cloning site, SV40 polyA), and approximately 2.5 kb of the RhAd60 genome starting before pIX
Figure 28:
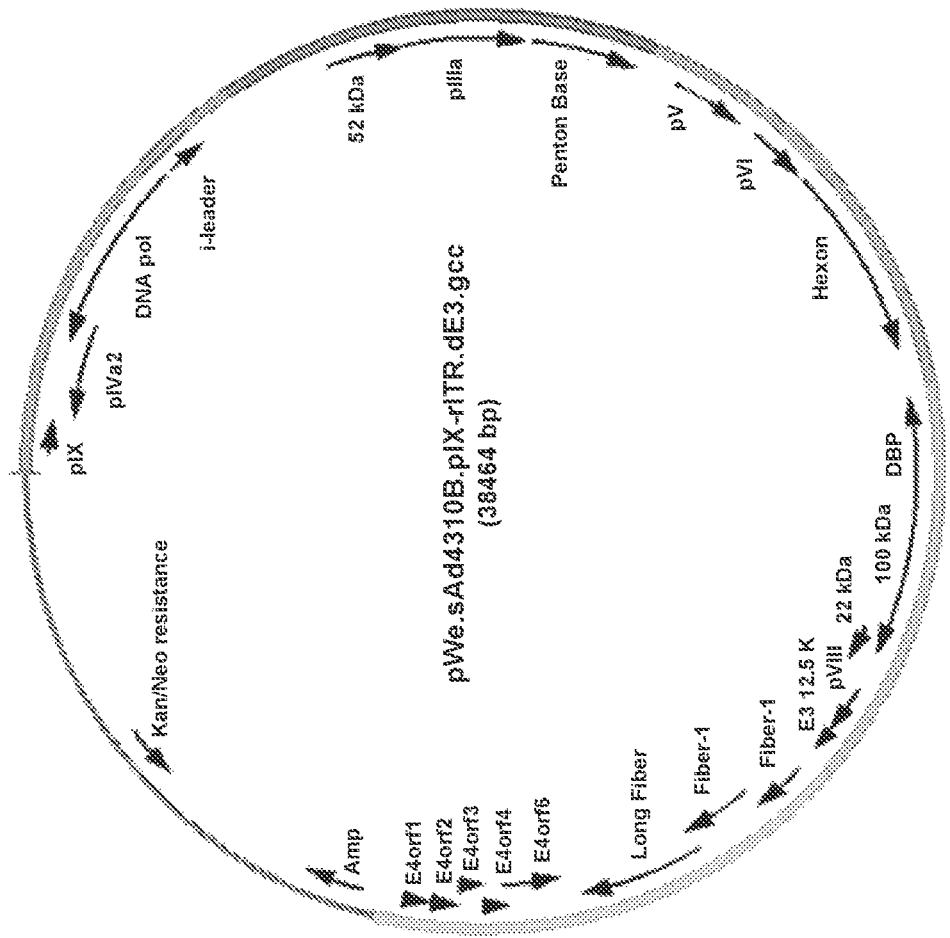
FIG. 28 is a schematic map of plasmid pWe/RhAd60.pIX-rITR.dE3 (SEQ ID NO: 245), which contains the remainder of the RhAd60 genome from pIX through rITR, but lacks the E3 region.
Figure 29:
FIG. 29 is a schematic map of plasmid RhAdApt61.Empty (SEQ ID NO: 246), which contains the left ITR, an E1 deletion, Transgene Cassette (CMV promoter, multiple cloning site, SV40 polyA), and approximately 2.5 kb of the RhAd61 genome starting before pIX.
Figure 30:
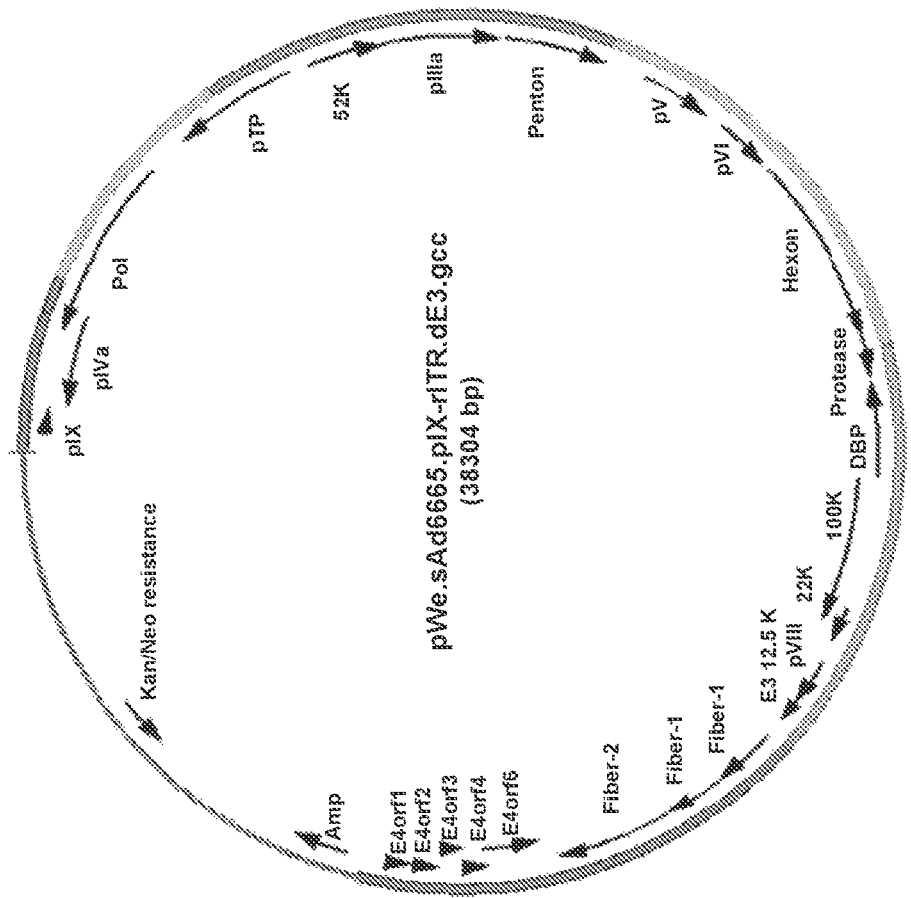
FIG. 30 is a schematic map of plasmid pWe/RhAd61.pIX-rITR.dE3 (SEQ ID NO: 247), which contains the remainder of the RhAd61 genome from pIX through rITR but lacks the E3 region.
Figure 31:
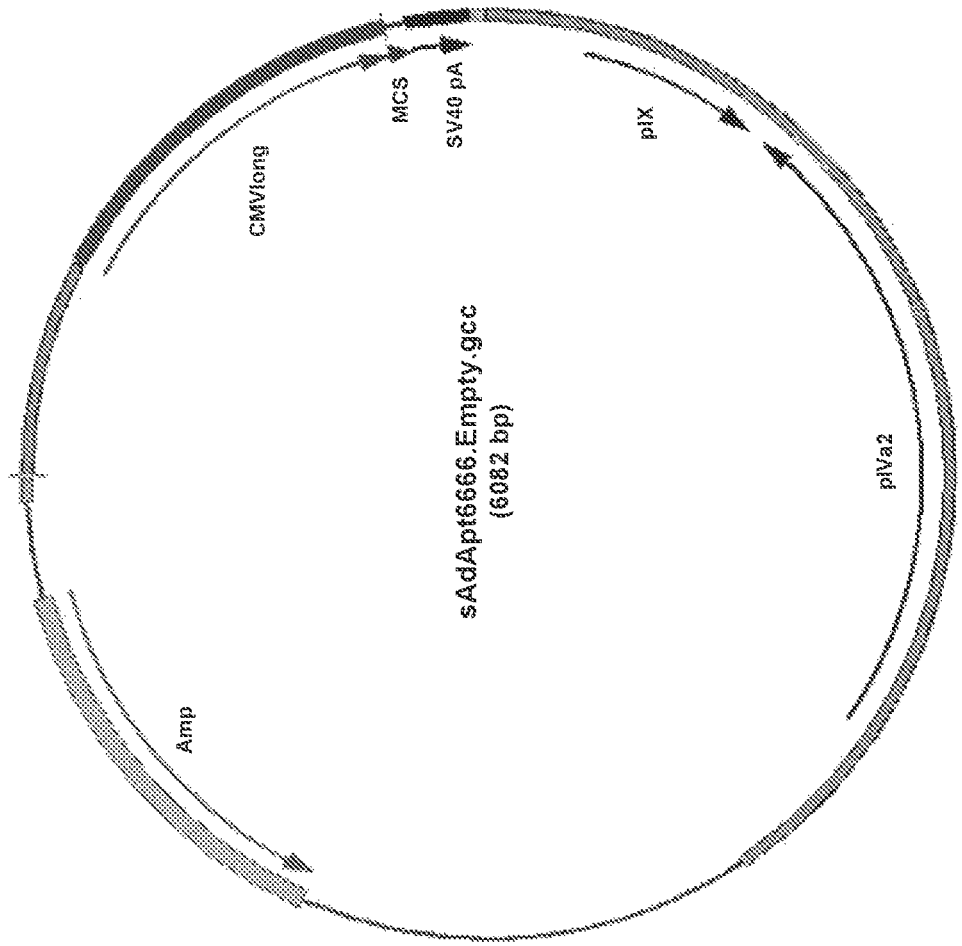
FIG. 31 is a schematic map of plasmid RhAdApt62.Empty (SEQ ID NO: 248), which contains the left ITR, an E1 deletion, Transgene Cassette (CMV promoter, multiple cloning site, SV40 polyA), and approximately 2.5 kb of the RhAd62 genome starting before pIX.
Figure 32:
FIG. 32 is a schematic map of plasmid pWe/RhAd62.pIX-rITR.dE3 (SEQ ID NO: 249), which contains the remainder of the RhAd62 genome from pIX through rITR, but lacks the E3 region.
Figure 33:
FIG. 33 is a schematic map of plasmid RhAdApt63.Empty (SEQ ID NO: 250), which contains the left ITR, an E1 deletion, Transgene Cassette (CMV promoter, multiple cloning site, SV40 polyA), and approximately 2.5 kb of the RhAd63 genome starting before pIX.
Figure 34:
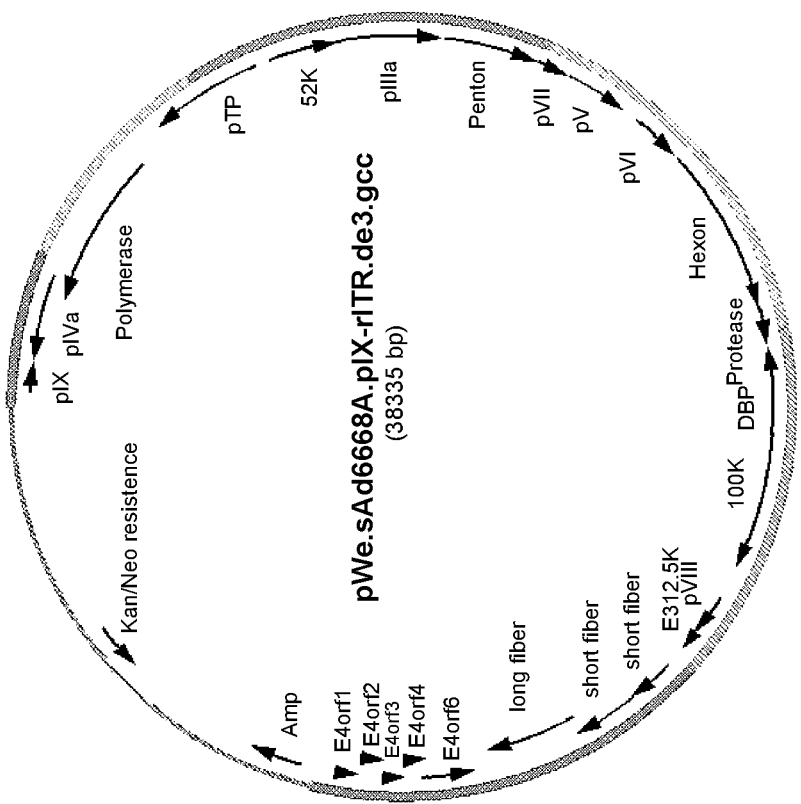
FIG. 34 is a schematic map of plasmid pWe/RhAd63.pIX-rITR.dE3 (SEQ ID NO: 251), which contains the remainder of RhAd63 genome from pIX through rITR, but lacks the E3 region.
Figure 35:
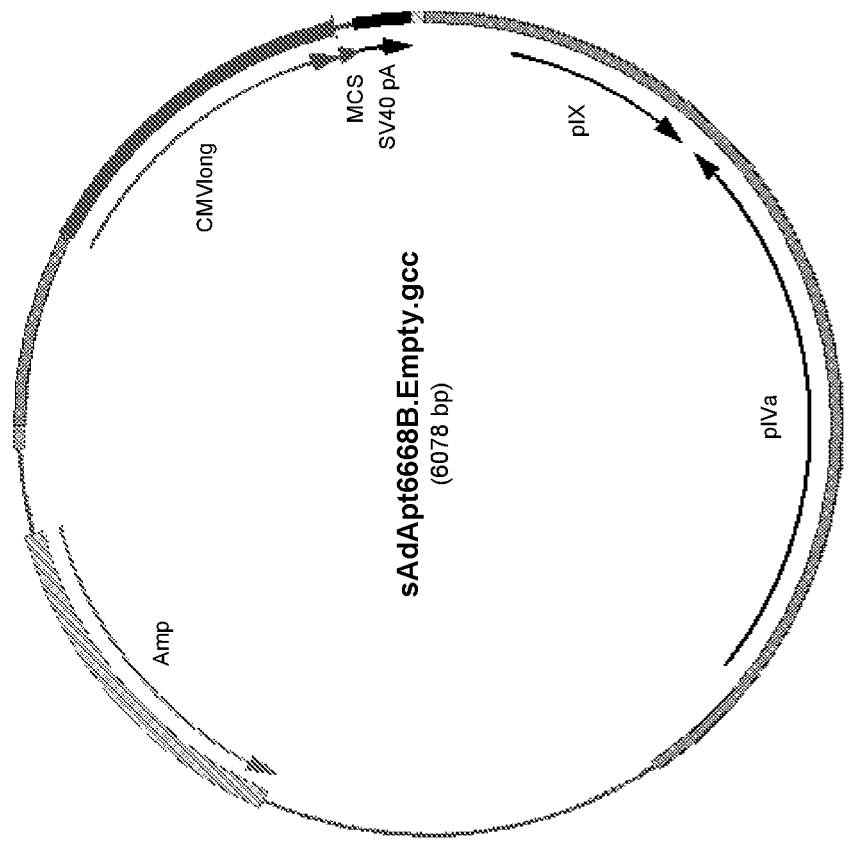
FIG. 35 is a schematic map of plasmid RhAdApt64.Empty (SEQ ID NO: 252), which contains the left ITR, an E1 deletion, Transgene Cassette (CMV promoter, multiple cloning site, SV40 polyA), and approximately 2.5 kb of the RhAd64 genome starting before pIX
Figure 36:
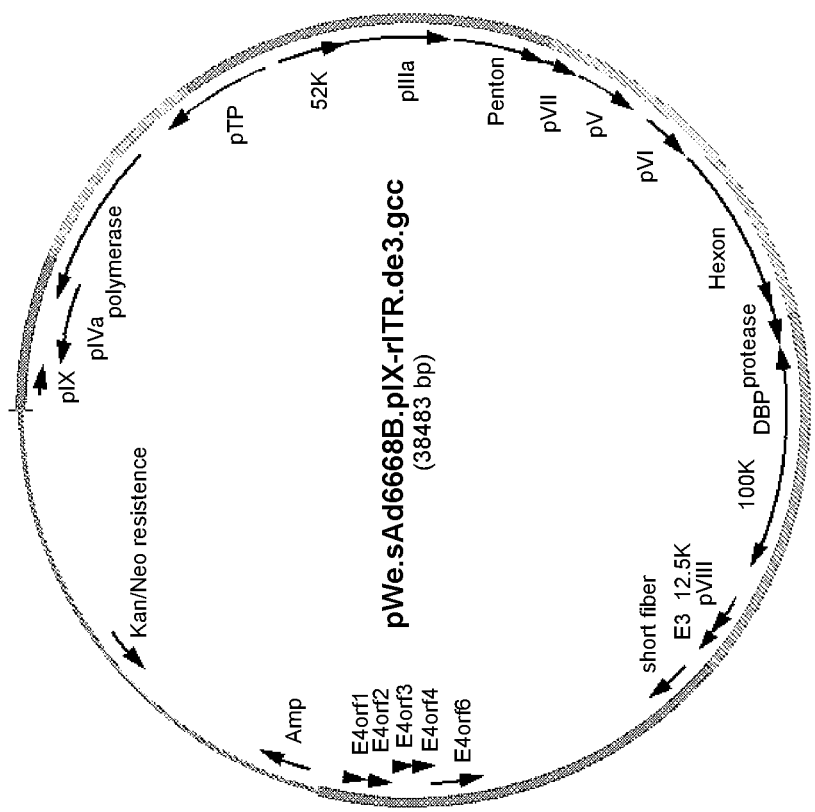
FIG. 36 is a schematic map of plasmid pWe/RhAd64.pIX-rITR.dE3 (SEQ ID NO: 253), which contains the remainder of the RhAd64 genome from pIX through rITR, but lacks the E3 region.
Figure 37:
FIG. 37 is a schematic map of plasmid RhAdApt65.Empty (SEQ ID NO: 254), which contains the left ITR, an E1 deletion, Transgene Cassette (CMV promoter, multiple cloning site, SV40 polyA), and approximately 2.5 kb of the RhAd65 genome starting before pIX.
Figure 38:
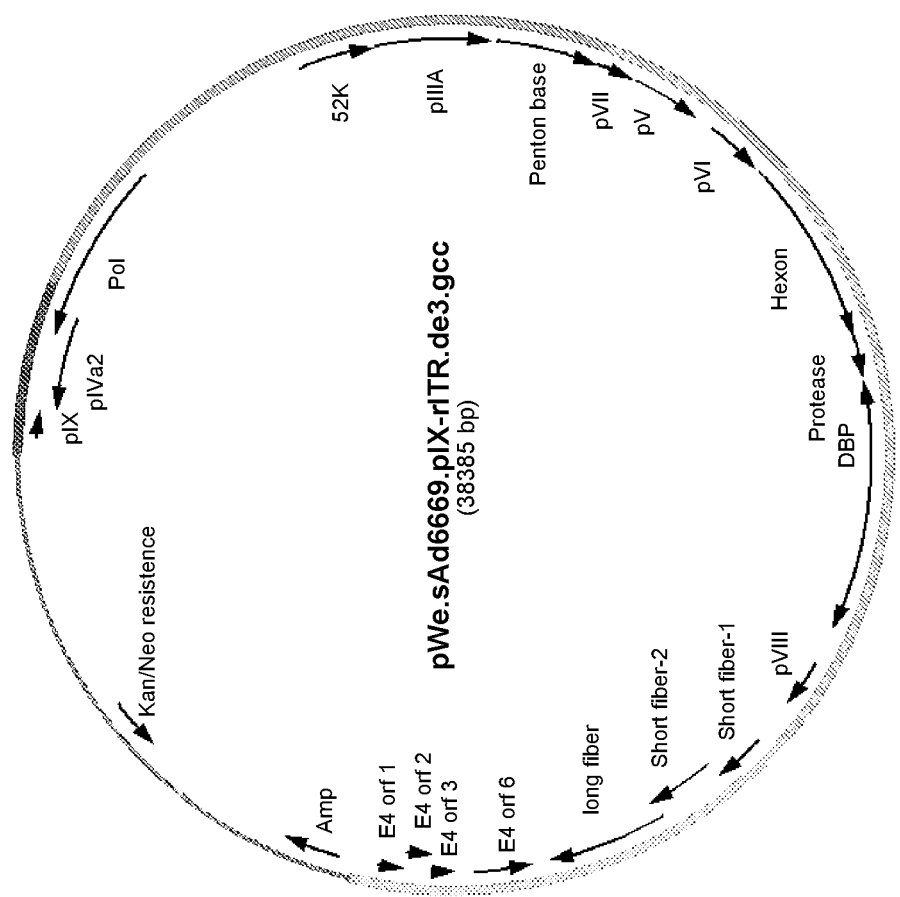
FIG. 38 is a schematic map of plasmid pWe/RhAd65.pIX-rITR.dE3 (SEQ ID NO: 255), which contains the remainder of the RhAd65 genome from pIX through rITR, but lacks the E3 region.
Figure 39:
FIG. 39 is a schematic map of plasmid RhAdApt66.Empty (SEQ ID NO: 256), which contains the left ITR, an E1 deletion, Transgene Cassette (CMV promoter, multiple cloning site, SV40 polyA), and approximately 2.5 kb of the RhAd66 genome starting before pIX.
Figure 40:
FIG. 40 is a schematic map of plasmid RhAdApt66.v2.Empty (SEQ ID NO: 257), which contains the left ITR, an E1 deletion, Transgene Cassette (CMV promoter, multiple cloning site, SV40 polyA), and approximately 2.5 kb of the RhAd66 genome starting before pIX. The last remaining ~190 bp of E1 that were present before the pIX in RhAdApt.Empty have been deleted.
Figure 41:
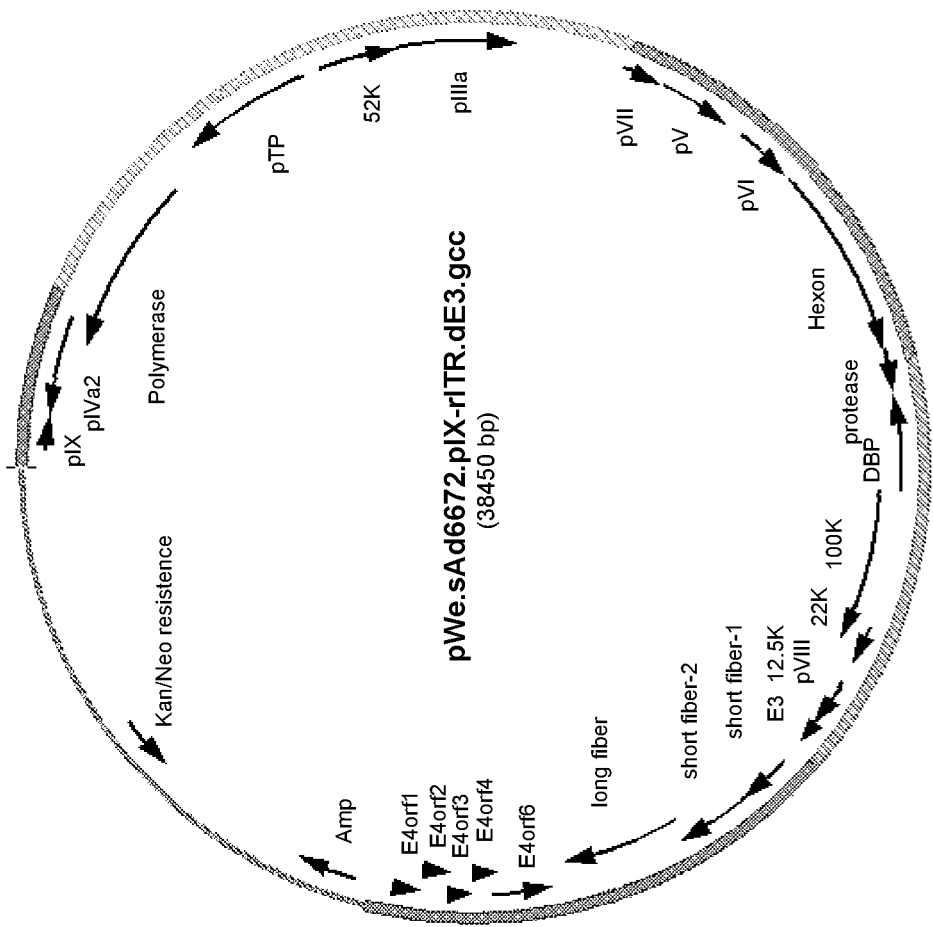
FIG. 41 is a schematic map of plasmid pWe/RhAd66.pIX-rITR.dE3 (SEQ ID NO: 258), which contains the remainder of the RhAd66 genome from pIX through rITR, but lacks the E3 region.
Figure 42:
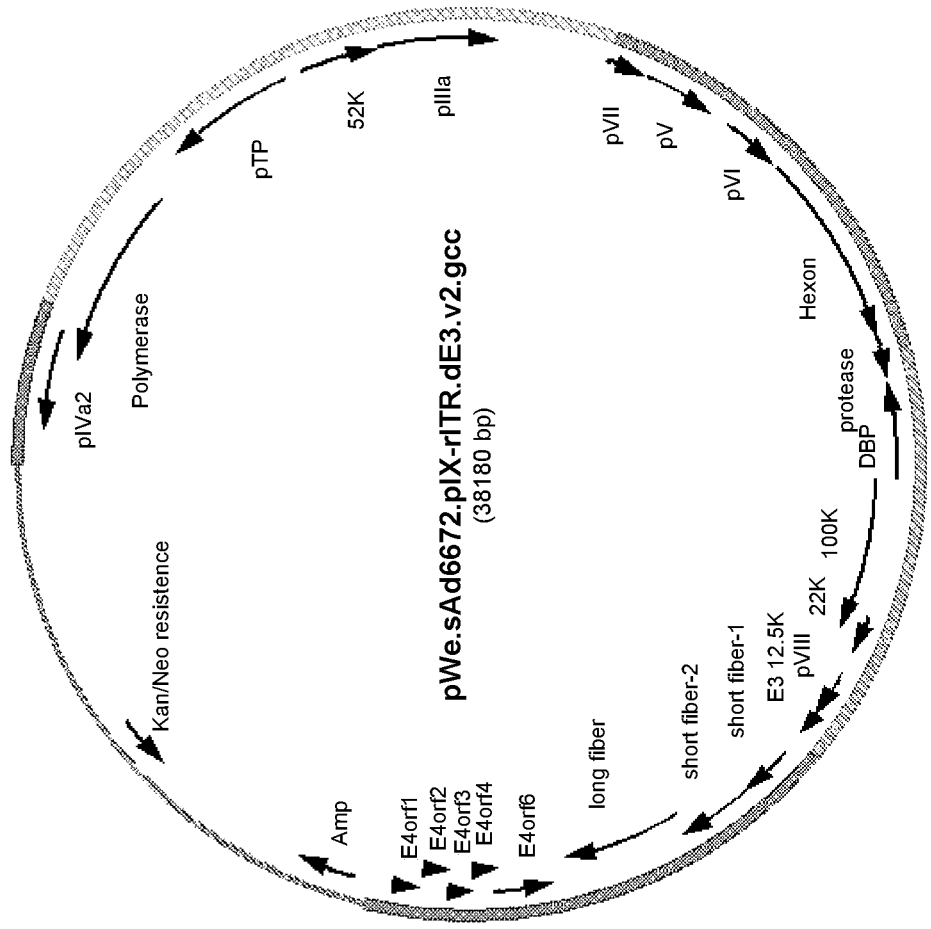
FIG. 42 is a schematic map of plasmid pWe/RhAd66.v2.pIX-rITR.dE3 (SEQ ID NO: 259), which contains the remainder of the RhAd66 genome from pIX through rITR, but lacks the E3 region. The last remaining ~190 bp of E1 that were present before the pIX in pWe/RhAd.pIX-rITR.dE3 have been deleted.
Figure 43:
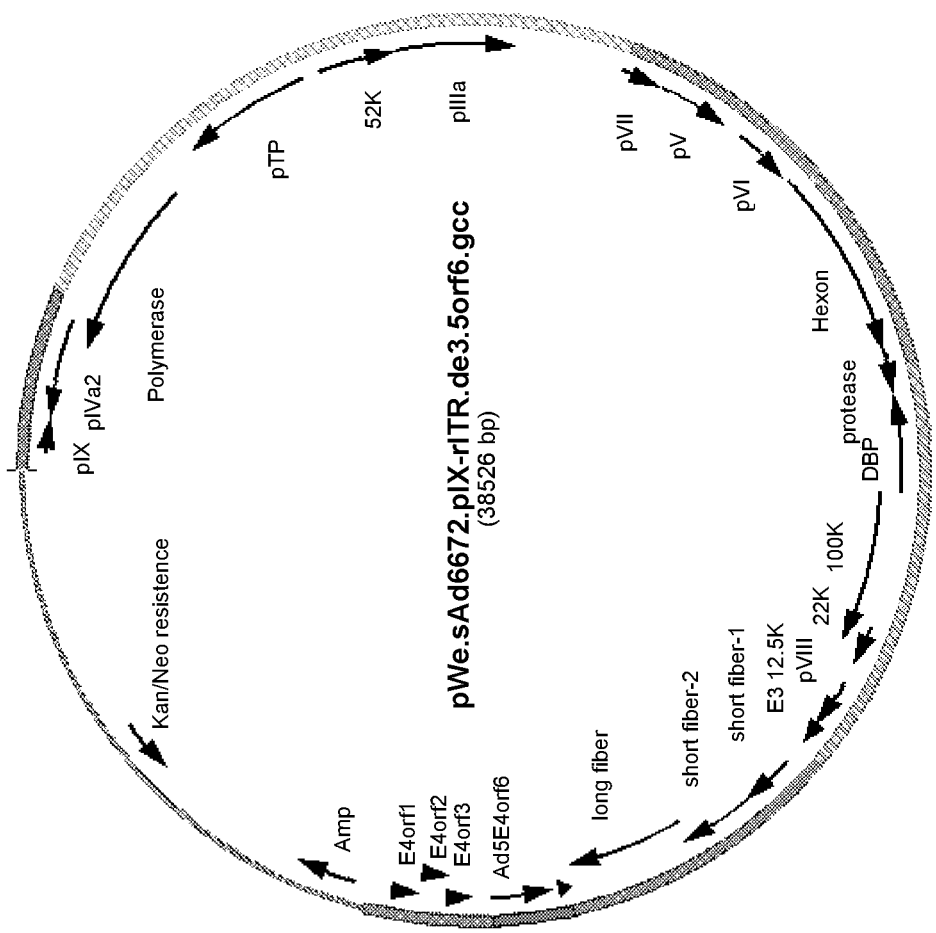
FIG. 43 is a schematic map of plasmid pWe/RhAd66.v2.pIX-rITR.dE3.5orf6 (SEQ ID NO: 260), which contains the remainder of the RhAd66 genome from pIX through rITR, but lacks the E3 region. RhAd66 E4orf has been swapped with the E4orf6 of HuAd5.
Figure 44:
FIG. 44 is a schematic map of plasmid RhAdApt67.Empty (SEQ ID NO: 262), which contains the left ITR, an E1 deletion, Transgene Cassette (CMV promoter, multiple cloning site, SV40 polyA), and approximately 2.5 kb of the RhAd67 genome starting before pIX.
Figure 45:
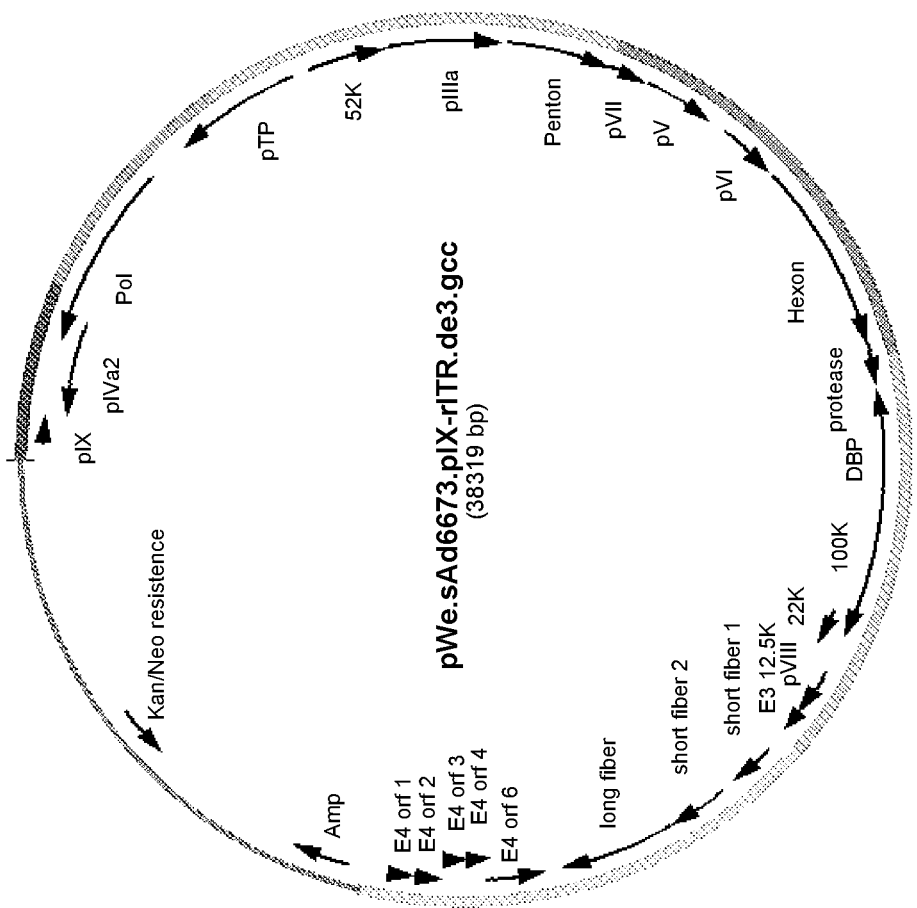
FIG. 45 is a schematic map of plasmid pWe/RhAd67.pIX-rITR.dE3 (SEQ ID NO: 263), which contains the remainder of the RhAd67 genome from pIX through rITR, but lacks the E3 region.
Figure 46A:
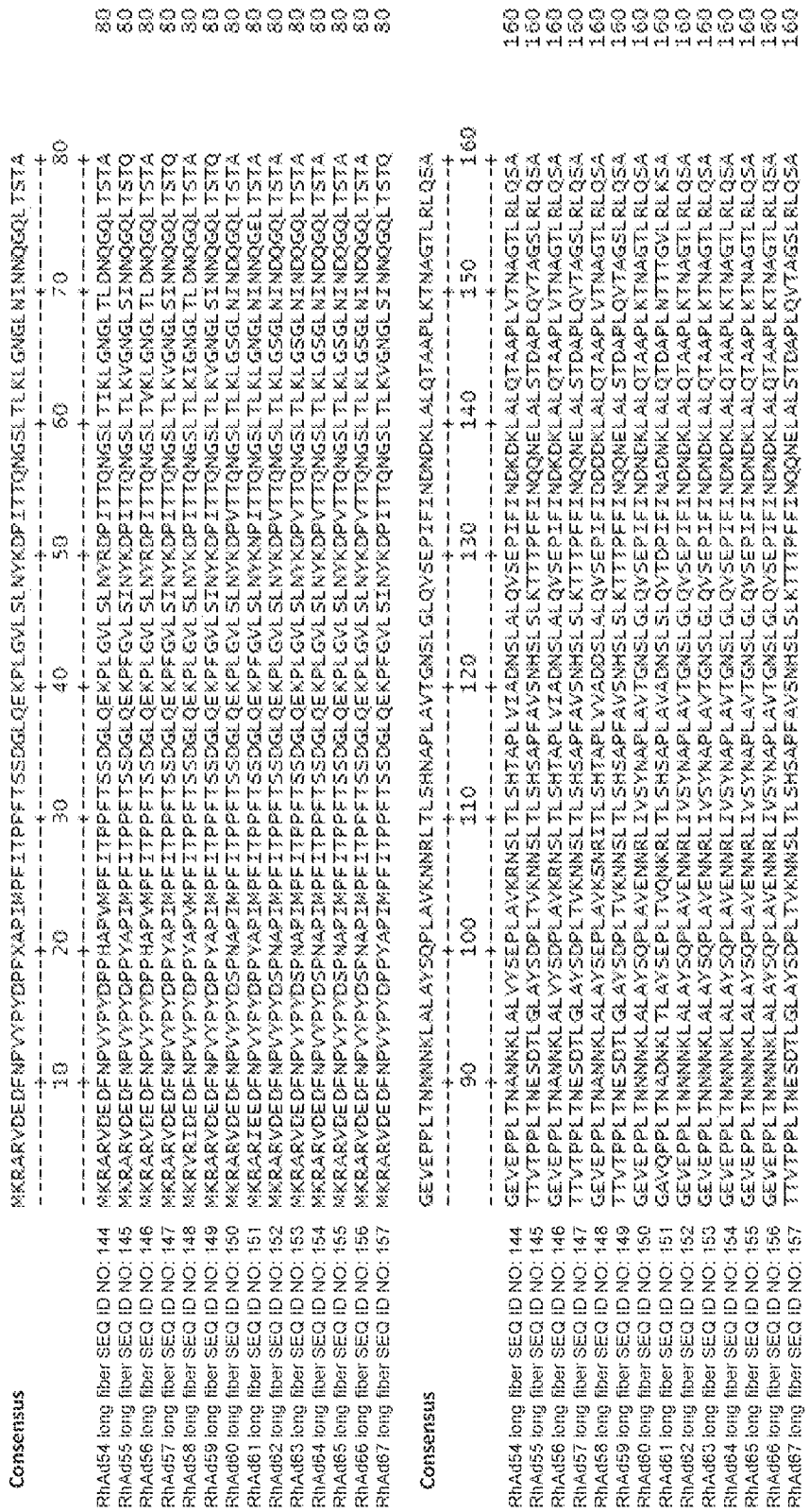
FIGS. 46A-46D are a series of images depicting an alignment of the polypeptide sequences of the long fiber proteins of RhAd54-RhAd67, which correspond to SEQ ID NOs: 144-157, respectively. A consensus sequence corresponding to the alignment of the long fiber proteins of RhAd54-RhAd67 is also provided (SEQ ID NO: 264).
Figure 46B:
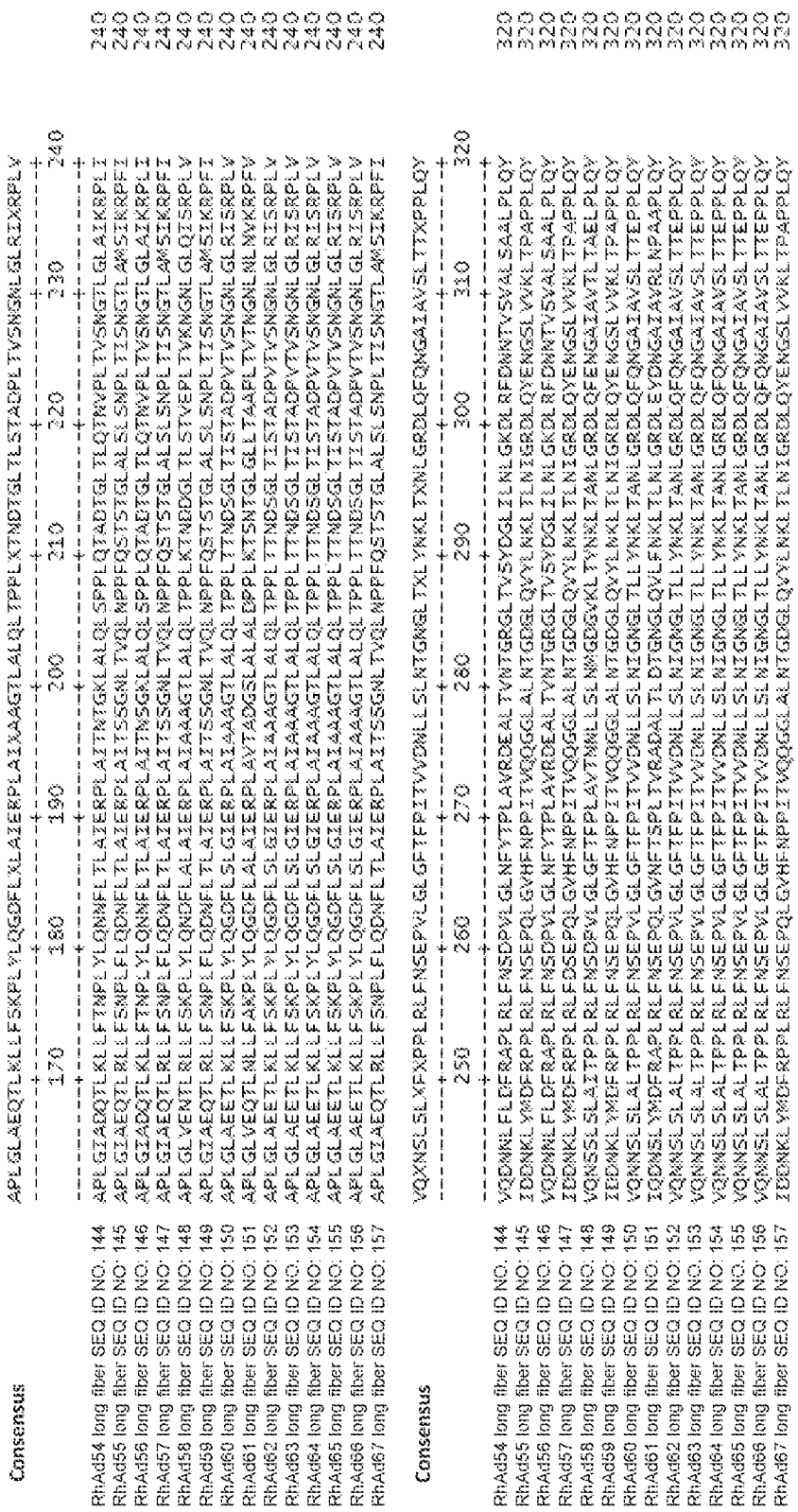
Figure 46C:
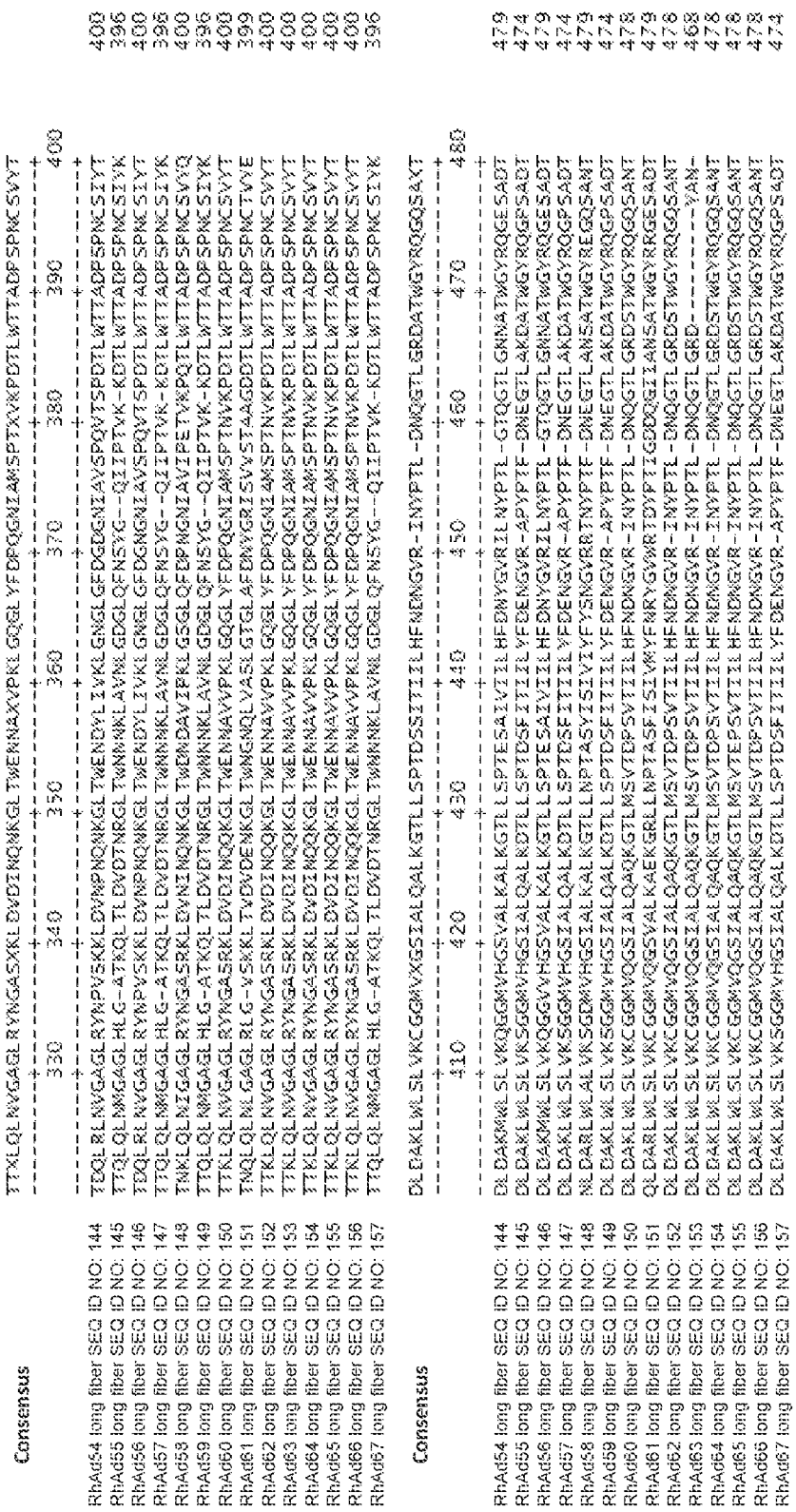
Figure 46D:
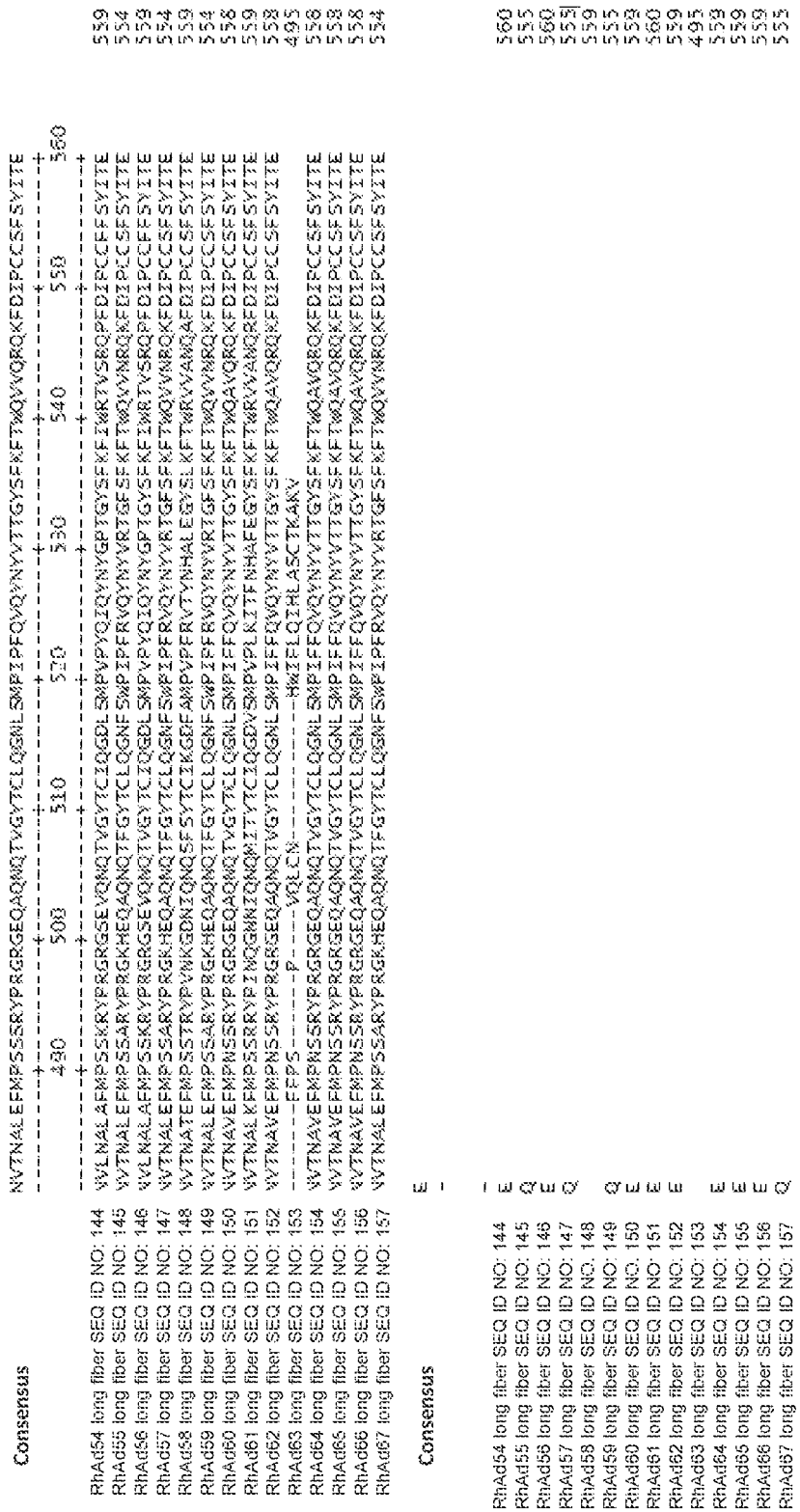

Virus isolation. We previously reported the construction of three rhesus adenovirus vectors (RhAd51-53; see Abbink et al., *J Virol.* 89(3):1512-22, 2015, and PCT Publication No. WO 2014/078688; incorporated herein by reference). We now report the isolation of 14 additional adenoviruses from stool filtrates of rhesus monkeys. Plaque purified viruses were expanded and viral DNA was sent out for whole genome 454 sequencing (Seqwright® GE Healthcare, Houston, Tex.). All viruses were previously unknown and were termed RhAd54-67 (Genbank accession numbers MF198448-MF198461). Whole genome sequences were then analyzed by maximum likelihood phylogenetic trees, as described in Chevenet et al. (*BMC Bioinformatics.* 7:439, 2006) and Dereeper et al. (*Nucleic Acids Res.* 36:W465-9, 2008), respectively. All rhesus adenoviruses grouped with the poorly defined species G, with the majority of differences observed in the hexon (FIGS. 1A and 1B). The genomic structure of RhAds proved similar to human Ad5, except RhAds encoded 2 or 3 fibers, whereas most human and chimpanzee Ads encode 1 or 2 fibers (FIG. 10).

Figure 2A:
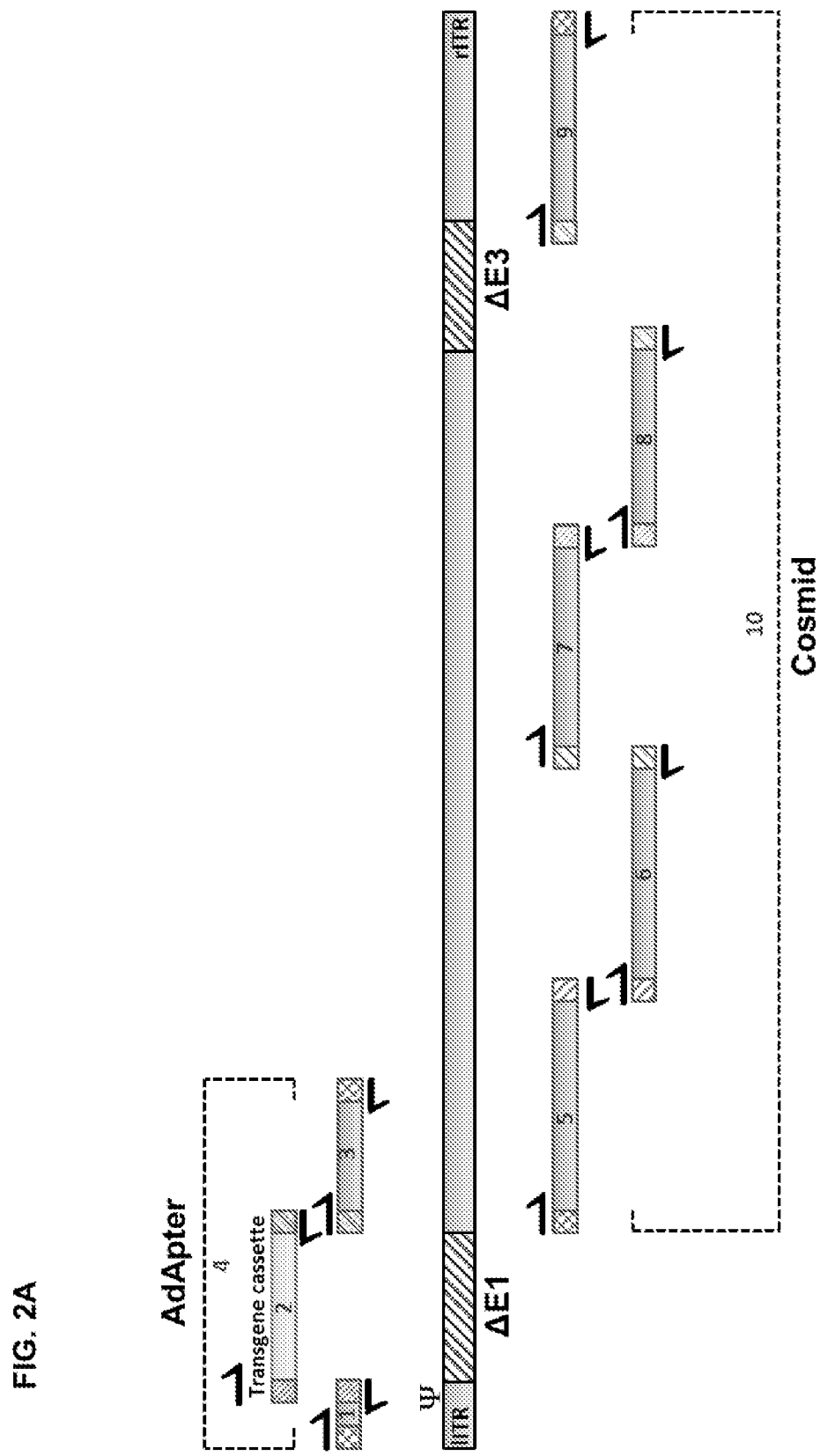
FIG. 2A is an image showing a schematic representation of adenovirus whole genome fragments generated by PCR for assembly into the AdApter plasmid and cosmid. Matching overhangs of adjacent PCR fragments are indicated by matched pattern.

Vector construction. We next used Gibson assembly cloning techniques to construct adenovirus vectors. The Gibson cloning method (Gibson et al., *Nat Methods.* 6(5):343-5, 2009) utilizes 20-60 bp DNA overhangs of adjacent double stranded DNA fragments. In a single reaction, 5'-exonuclease generates 3' single stranded matching overhangs anneal together and are repaired by polymerase and ligase. For vector construction, the complete rhesus adenovirus genomes were divided into fragments that were assembled into an E1-deleted AdApter plasmid, containing the left ITR through pIX and pIVa2 sequences, and an E3-deleted cosmid that contains the pIX through the right ITR (FIG. 2A). For each of these constructs the genome was divided into shorter fragments and amplified by PCR (FIG. 2B). Assembled constructs were transformed into *E. coli* and colonies were screened (FIGS. 2C and 2D). Cloning of the RhAd vectors took an average of one week to complete from wild type adenovirus genome into E1/E3 deleted plasmids, which we used directly in transfections to obtain recombinant vector growth. Included in this cloning was the introduction of a transgene cassette with or without a transgene, such as eGFP, luciferase, or SIVgag. The use of high fidelity polymerases generally yielded PCR fragments free from unintended mutations, but overlapping junction regions that recombine during Gibson assembly were more error prone, with mutation observed in 10-20% of the constructs. Final selected vector plasmids and cosmids were verified by sequencing to match the wild type genome. RhAd vector constructs were transfected in E1 complementing cells, and vector batches were produced as previously described (Abbink et al., *J Virol.* 81(9):4654-63, (2007)). We produced purified batches of all RhAd vectors except RhAd67, which we were unable to purify due to aggregation of virus particles using our standard purification protocol.

Figure 3A:
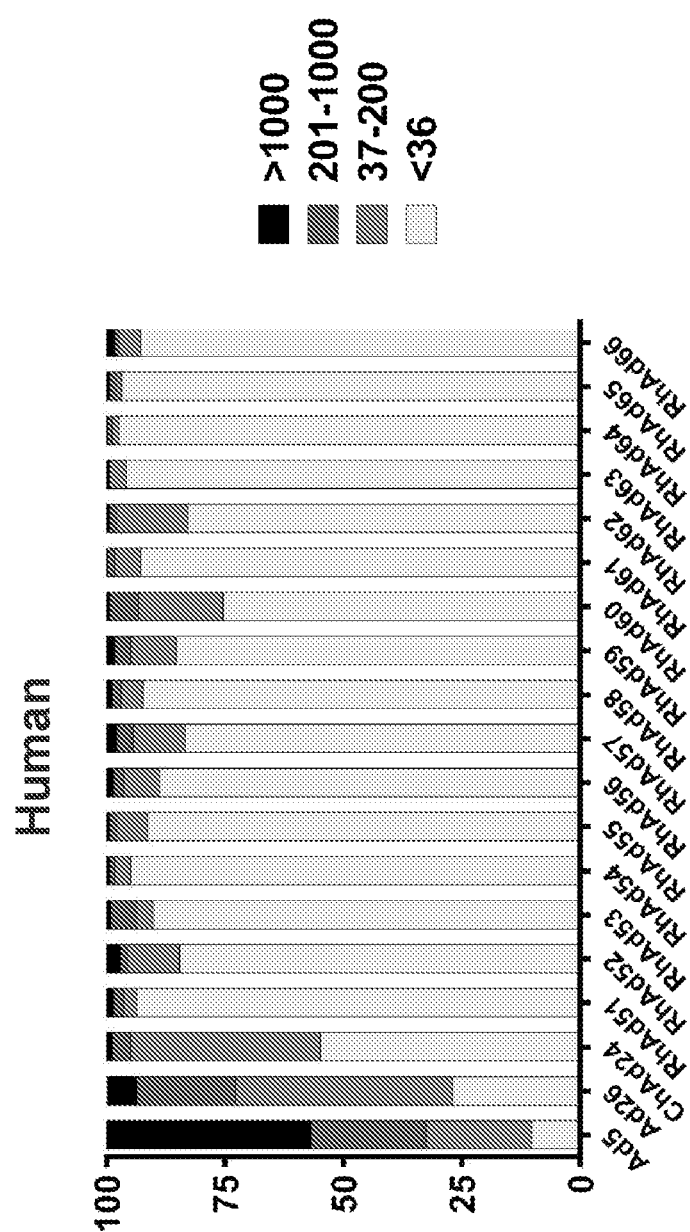
FIG. 3A is a graph showing seroprevalence of the RhAd vectors determined in 200 human serum samples from South Africa and Rwanda. Titers are graphed as dilution at which 90 percent of virus gets neutralized by antibodies present in the serum. Assay sensitivity cutoff is a dilution of 36.
Figure 3B:
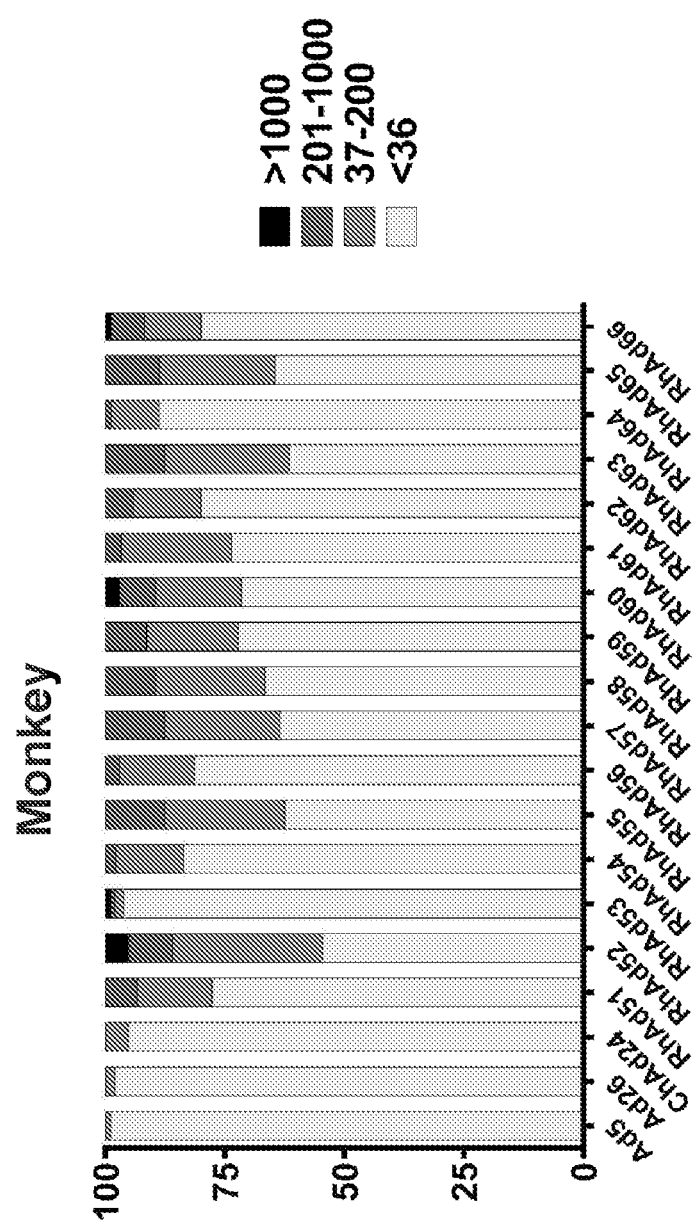
FIG. 3B is a graph showing seroprevalence of the RhAd vectors determined in 107 naïve rhesus monkeys. Titers are graphed as dilution at which 90 percent of virus gets neutralized by antibodies present in the serum. Assay sensitivity cutoff is a dilution of 36.

Seroprevalence. Seroprevalence in both human and rhesus monkey populations was determined using luciferase-based neutralization assays, as previously described (Sprangers et al., *J Clin Microbiol.* 41(11):5046-52, 2003). Seroprevalence was assessed in human populations from South Africa (n=100) and Rwanda (n=100), as well as in naive rhesus monkeys (n=107) (FIGS. 3A and 3B). All RhAd vectors developed here exhibited extremely low seroprevalence in these human populations with titers <36 in 76-98% of individuals and titers <200 in 94-99% of individuals. In contrast, for human Ad5, only 10% exhibited titers <36, and 67% had titers >200, and 43% had high titers of >1000. Human Ad26 and chimpanzee Ad24 demonstrated intermediate titers with 27-40% exhibiting titers <36 and 40-45% had titers between 36 and 200, consistent with prior reports (Barouch et al., *Vaccine.* 29(32):5203-9, (2011)). In contrast, the RhAd vectors showed higher seroprevalence than the human and chimpanzee Ad vectors in rhesus monkeys, as expected.

Figure 4A:
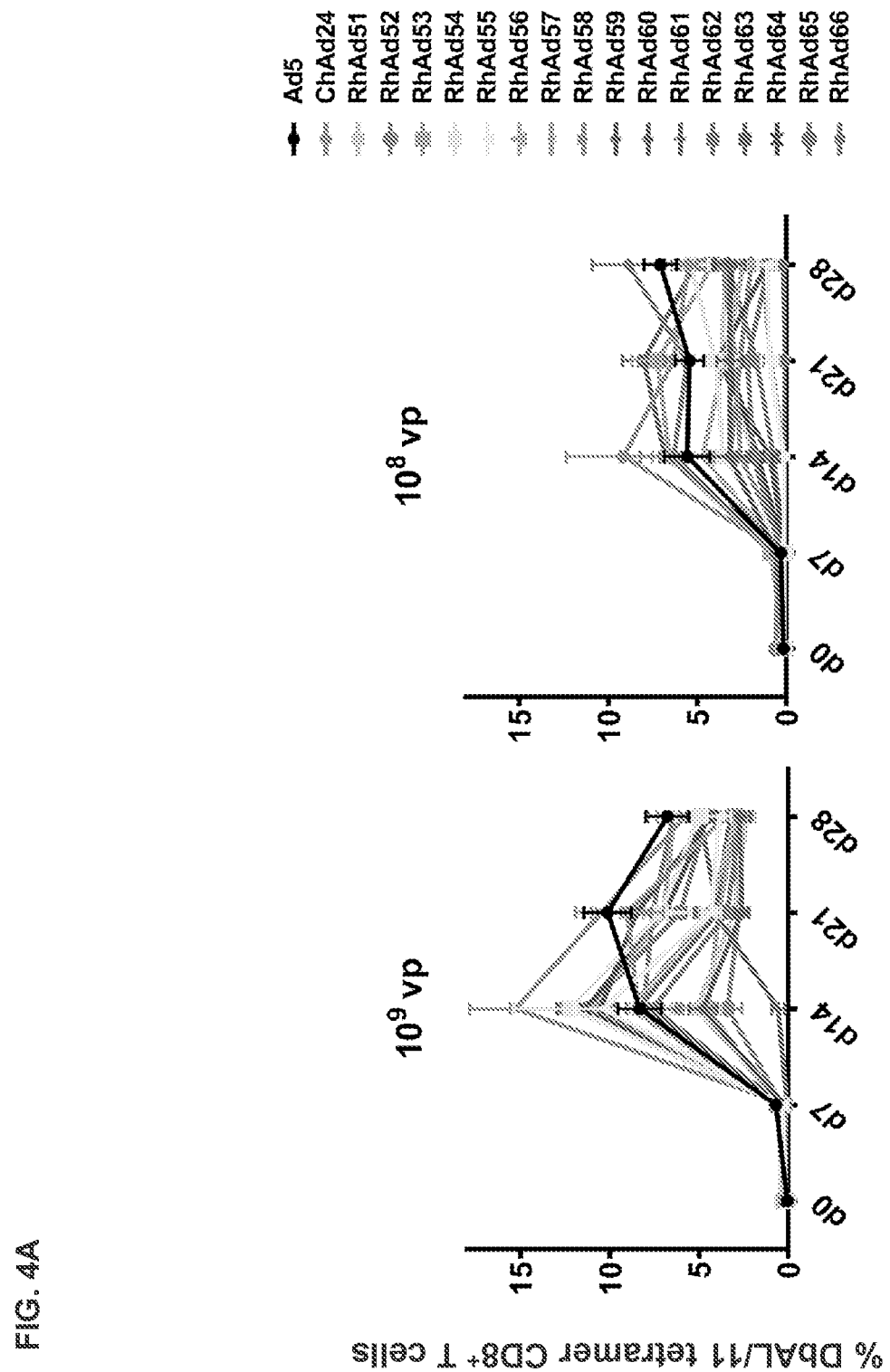
FIG. 4A presents two graphs showing mouse T-cell responses by $D^b$/AL11 CD8$^+$ T-cell tetramer binding assays in PBMC four weeks post immunization to the complete SIVgag peptide pool, the dominant CD8$^+$ T-cell AL11 epitope and subdominant CD8$^+$ T-cell KV9 and CD4$^+$ T-cell DD13 epitopes. Results are from C56BL/6 immunized mice (n=4) and a minimum of 2 repeat experiments. C57BL/6 mice were immunized once with $10^8$ or $10^9$ vp of RhAd vectors expressing SIVmac239 Gag, and db/AL11-specific CD8$^+$ T-cell responses in PBMC were assessed weekly.

Immunogenicity. We next evaluated the immunogenicity of this panel of RhAd vectors expressing the SIVgag antigen. SIVgag-specific cellular immune responses were assessed in mice using $D^b$/AL11 tetramer binding assays (Barouch et al., *J Immunol.* 172(10):6290-7, 2004). C57BL/6 mice (n=8/group) were immunized once with $10^8$ or $10^9$ vp of Ad vectors expressing SIVmac239 Gag, and $D^b$/AL11-specific CD8$^+$ T-cell responses in PBMC were assessed weekly. All RhAd vectors were immunogenic at both doses, with no significant differences compared to Ad5 (one-way ANOVA with Bonferroni corrections) (FIG. 4A). Peak responses for the RhAds were generally observed on day 14 as compared to day 21 for Ad5.

Figure 4B:
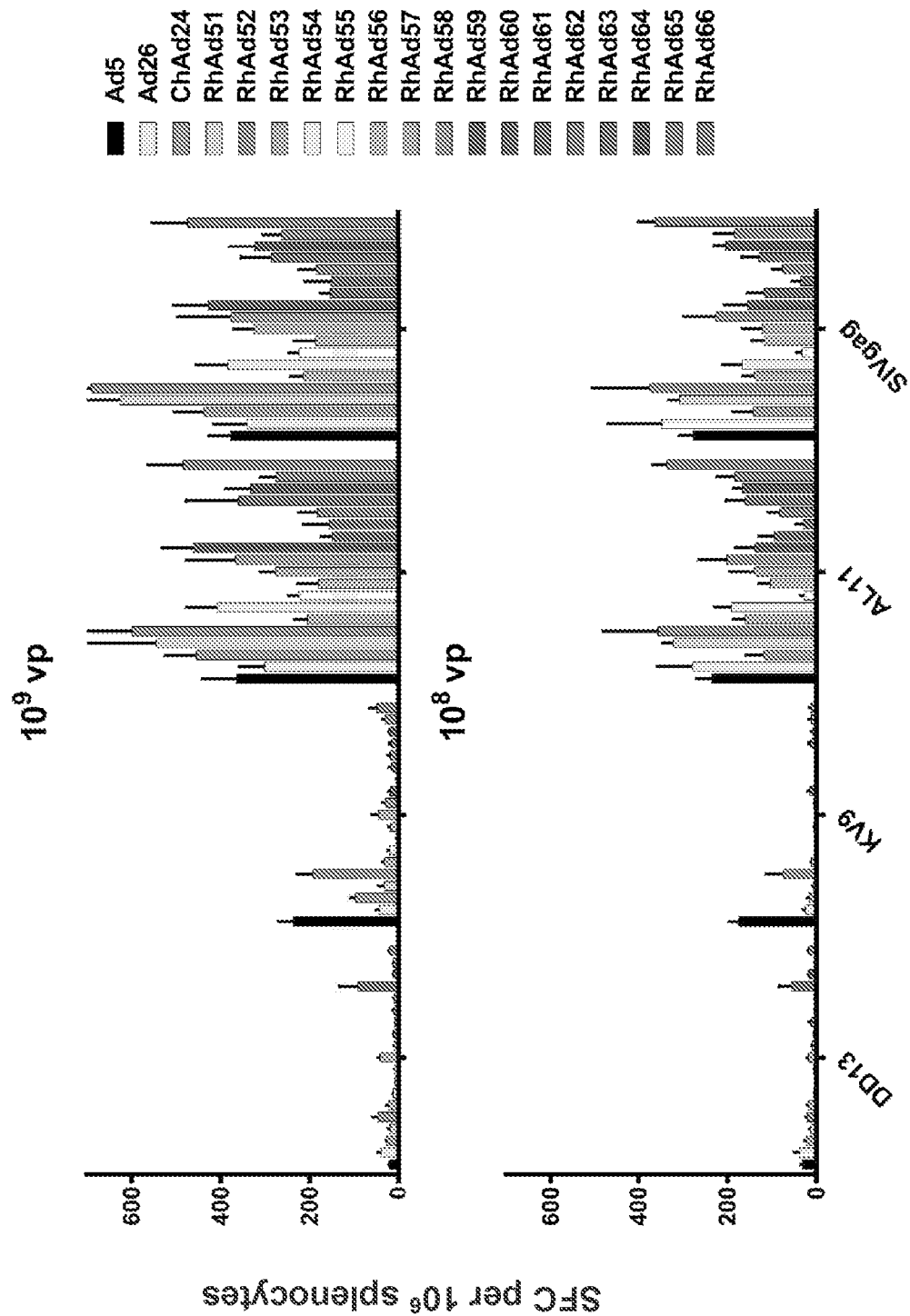
FIG. 4B presents two graphs showing mouse T ELISPOT responses in splenocytes four weeks post immunization ($10^8$ or $10^9$ vp of RhAd vectors) to the complete SlVgag peptide pool, the dominant CD8$^+$ T-cell AL11 epitope and subdominant CD8$^+$ T-cell KV9 and CD4$^+$ T-cell DD13 epitopes. Results are from C56BL/6 immunized mice (n=4) and a minimum of 2 repeat experiments.

We next assessed the functionality of the responses generated by performing ELISPOT assays in splenocytes in response to the SIVgag peptide pool, the CD8$^+$ T-cell epitopes AL11 and KV9, and the CD4$^+$ T-cell epitope DD13. Splenocytes were isolated 28 days post vaccination (Abbink et al., *J Virol.* 81(9):4654-63, 2007). All RhAd vectors demonstrated robust responses with non-significant variance among the different RhAd vectors by one-way ANOVA with Bonferroni correction (FIG. 4B). RhAd55, 61 and 62 showed the lowest CD8$^+$ T-cell responses and RhAd51, 52, 54, 59, and 66 show the highest CD8$^+$ T-cell responses. Ad5 and RhAd52 induced the strongest responses to the subdominant CD8$^+$ T-cell epitope KV9, whereas RhAd63 elicited the highest response to the CD4$^+$ T-cell epitope DD13.

Figure 5A:
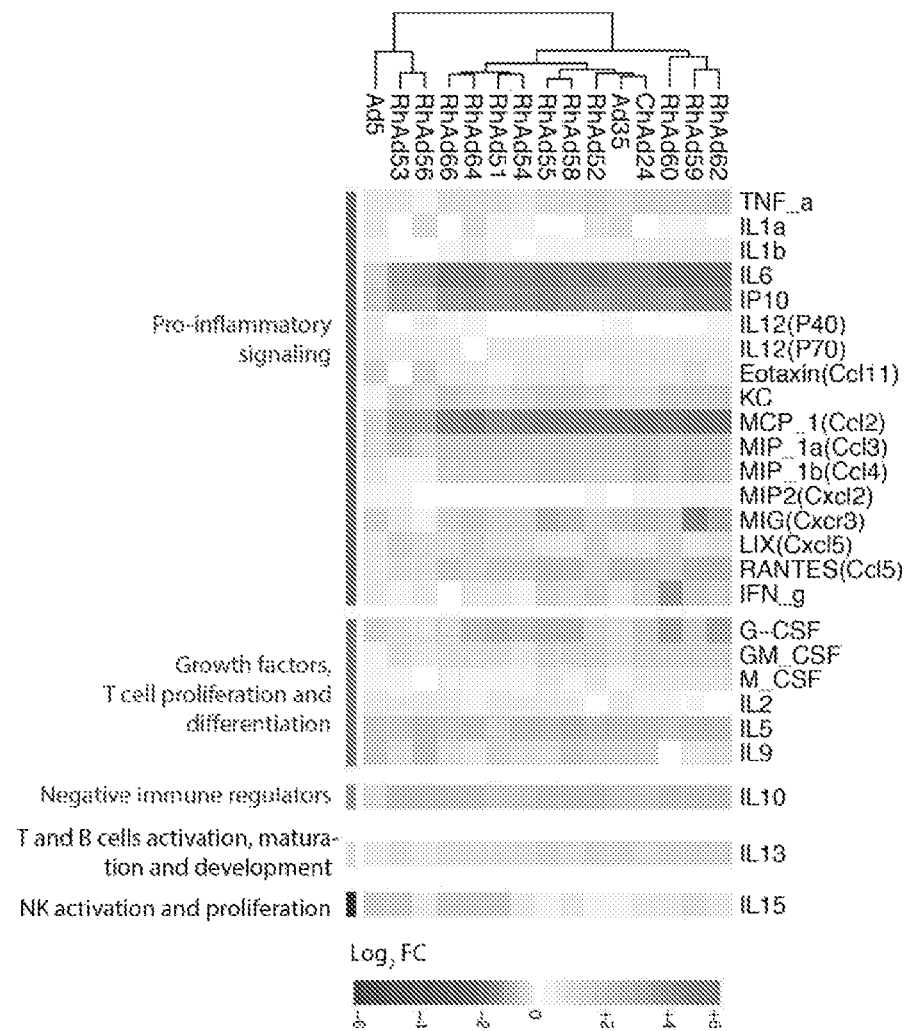
FIG. 5A is a heat map showing cytokine levels in C57BL/6 mouse serum (n=5) six hours post immunization with $10^{10}$ vp of RhAd vectors by luminex assays. Values were PBS subtracted and Log$_2$ transformed. Only significant values were plotted in a heatmap and non-significant values were set to '0'.
Figure 5B:
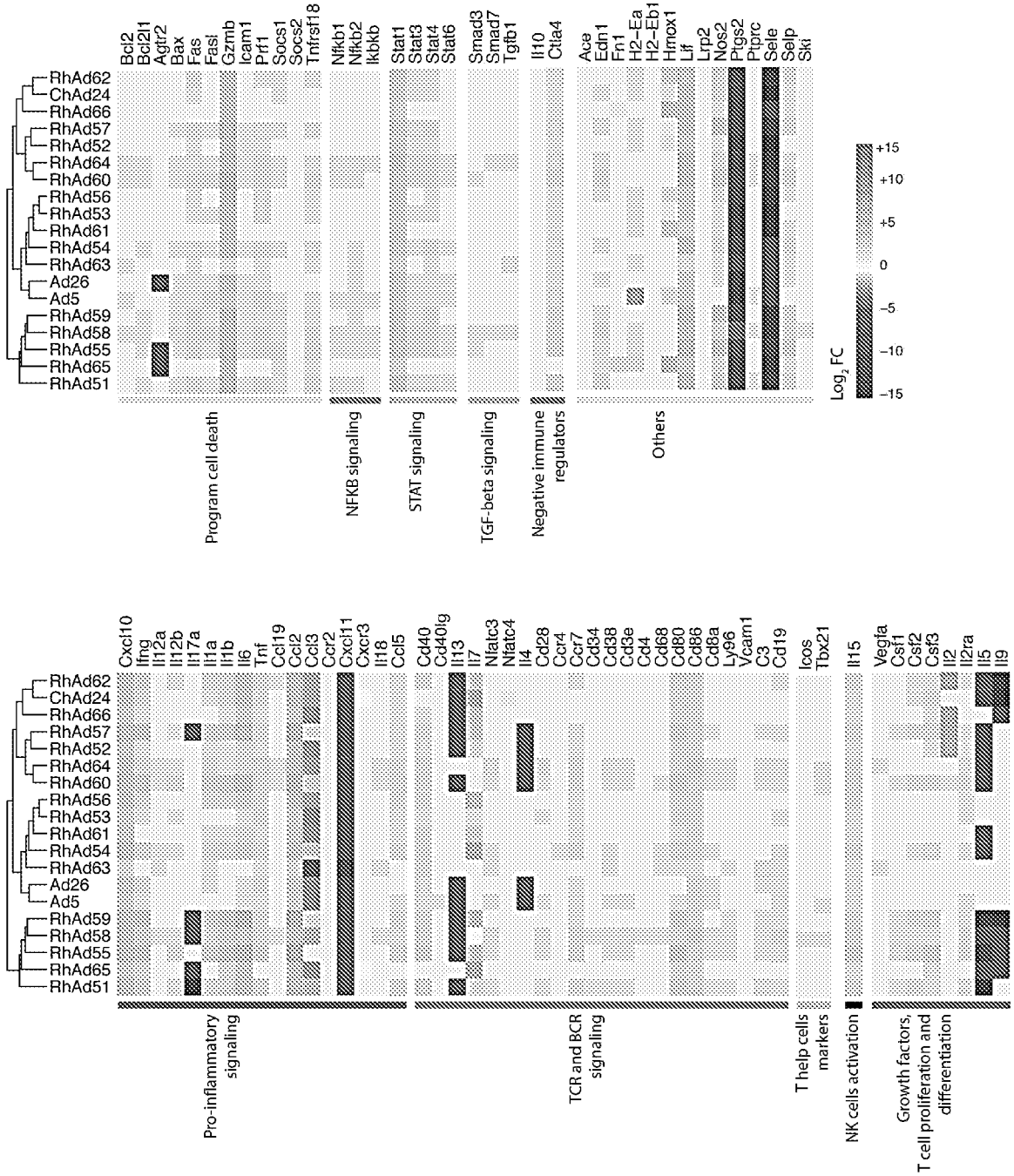
FIG. 5B is a heat map showing transcriptomic responses in mice by RT-array of total RNA extracted from iliac lymph nodes 24 hours post immunization (n=2). Log$_2$ transformed ΔΔCT values were plotted in a heat map and clustered by vectors that showed similar responses.
Figure 5C:
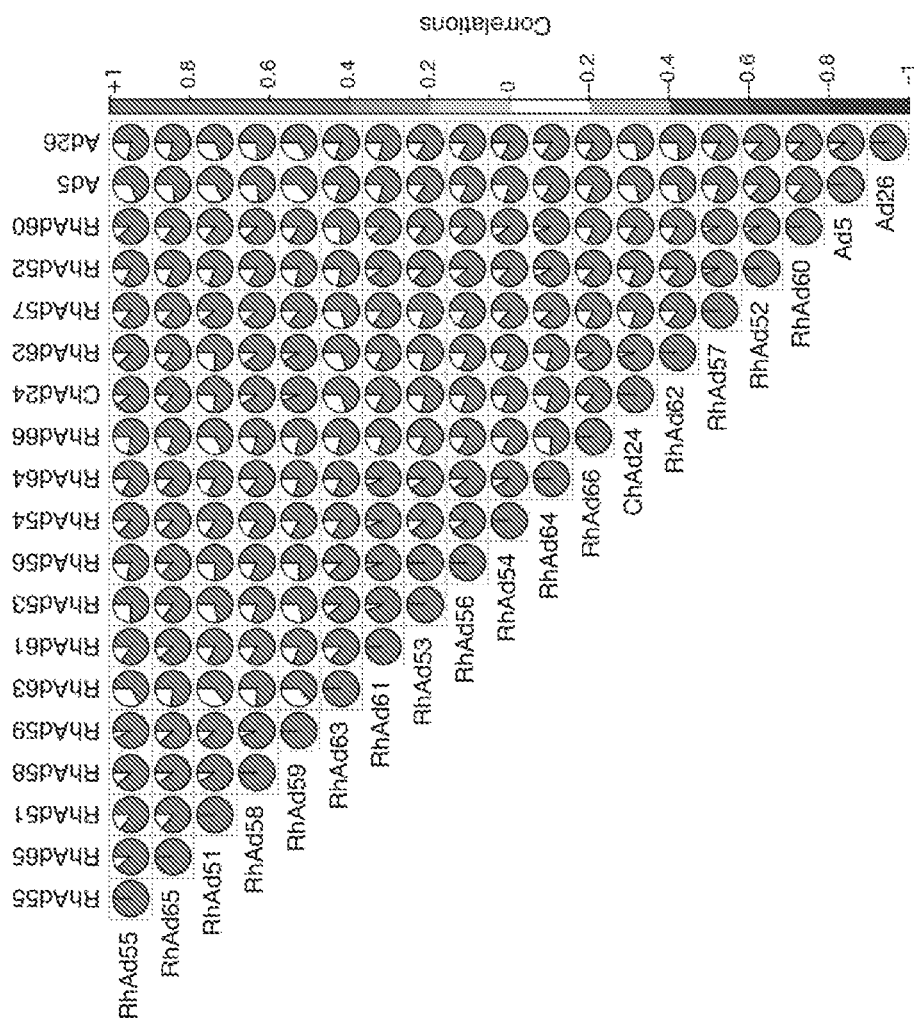
FIG. 5C is a correlogram showing correlation of the expression of innate and adaptive immune regulator markers, cytokines and chemokines (overall Pearson correlation>60%, P<0.05) among all vectors.

Innate immune responses were assessed in vivo by immunizing mice with $1\times10^{10}$ vp of Ad vectors not expressing any transgene. Six hours after immunization, serum analytes were assessed by a murine 32-plex cytokine/chemokine immunology assay (Millipore, Billerica, Mass.), and results were analyzed by Luminex xPONENT 4.2 software (Luminex, Austin, Tex.) (FIG. 5A). We also analyzed total RNA from iliac lymph nodes (LN) 24 hours post immunization by RT-Array (Applied Biosystems, Foster City, Calif.), focusing on the immune response pathways. For each gene, we measured the fold-change expression compared to naïve animals (FIG. 5B). In both blood and LN, a strong and rapid inflammatory response was induced by all vectors, as shown by increased expression of pro-inflammatory cytokines and chemokines, including IP10 (CXCL10), IFN-γ, TNF-α, IL1-α, IL1β, IL6, and MCP-1 (CCL2). The pro-inflammatory cytokine CXCL11, which plays a role in activated T cells, was decreased by all vectors. Several biological differences were apparent among RhAd vectors. While interleukin-2-receptor alpha (IL2ra) expression was increased by all vectors, IL2 gene expression was only increased by RhAd62, RhAd66, RhAd57, and RhAd52 at 24 hours post-immunization. Expression of IL7, a cytokine involved in survival, activation and homeostasis of B, T and NK cells, and IL13, a marker of T-helper (Th)-2 subset, were also decreased by several vectors 24 hours post-immunization, but IL13 expression was not decreased by RhAd53, 54, 56, 63, 64, and 65. Expression of IL4, a cytokine involved in differentiation of naïve Th-0 to Th-2 cells was decreased by Ad5, Ad26, RhAd52, RhAd57, RhAd64, and RhAd60. Several pro-apoptotic genes (Fas, FasI, Icam1, and Bax) and genes involved in cell killing functions (Perf1 and GzmB) were also increased by most vectors. Interestingly, Type-2 Angiotensin II Receptor (Atgr2), a marker of cell death, was highly decreased only by Ad26, RhAd55, and RhAd65. The expression of innate and adaptive immune regulator markers, cytokines, and chemokines were correlated (overall Pearson correlation >60%, P<0.05) among all vectors (FIG. 5C).

Figure 6A:
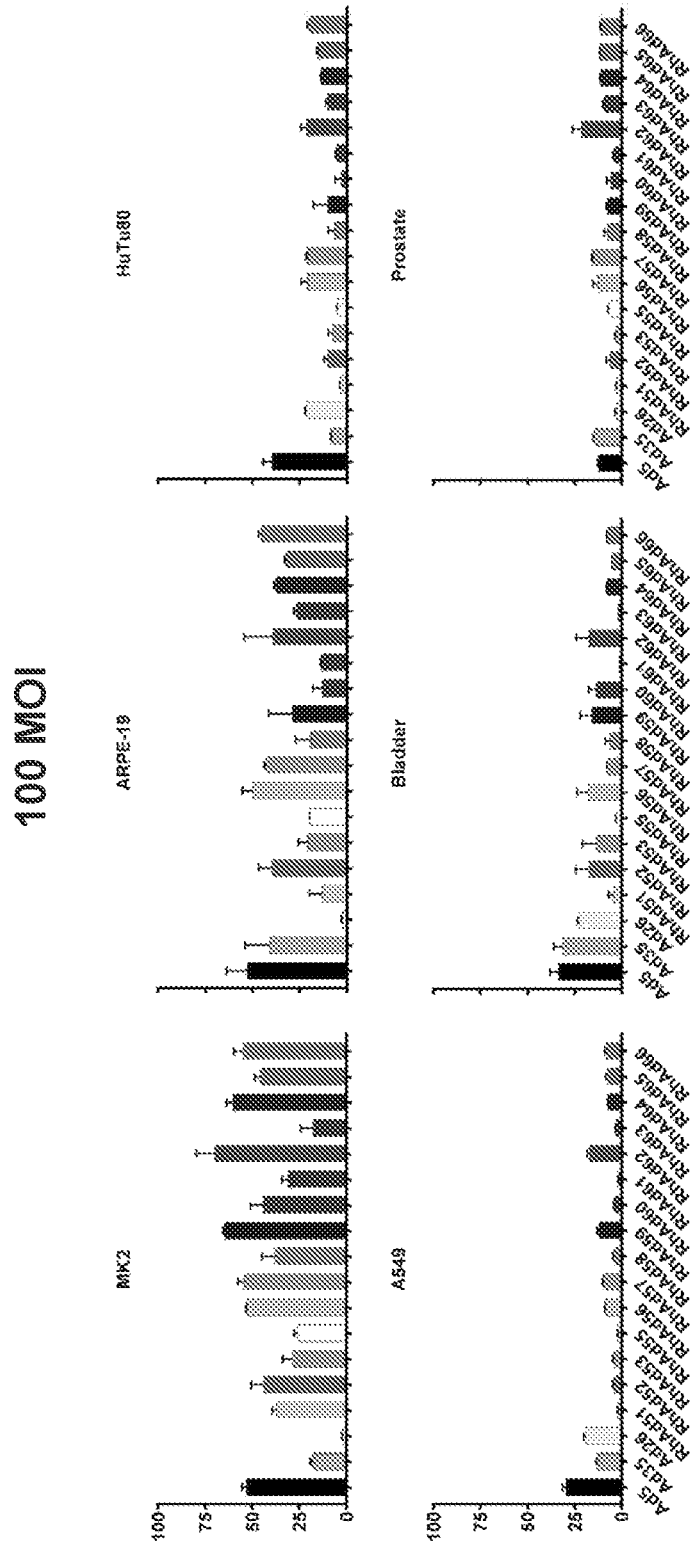
FIG. 6A is a series of graphs showing the tropism of adenovirus vectors in rhesus kidney cells (MK2), human retinal cells (ARPE-19), human duodenum adenocarcinoma cells (HuTu80), human lung carcinoma cells (A549), human primary prostate cells (prostate) and human primary bladder cells (bladder) at a multiplicity of infection (MOI) of 100. Results were run on LSRII flow cytometer 24 hours post infection and plotted as percentage eGFP positive cells.
Figure 6B:
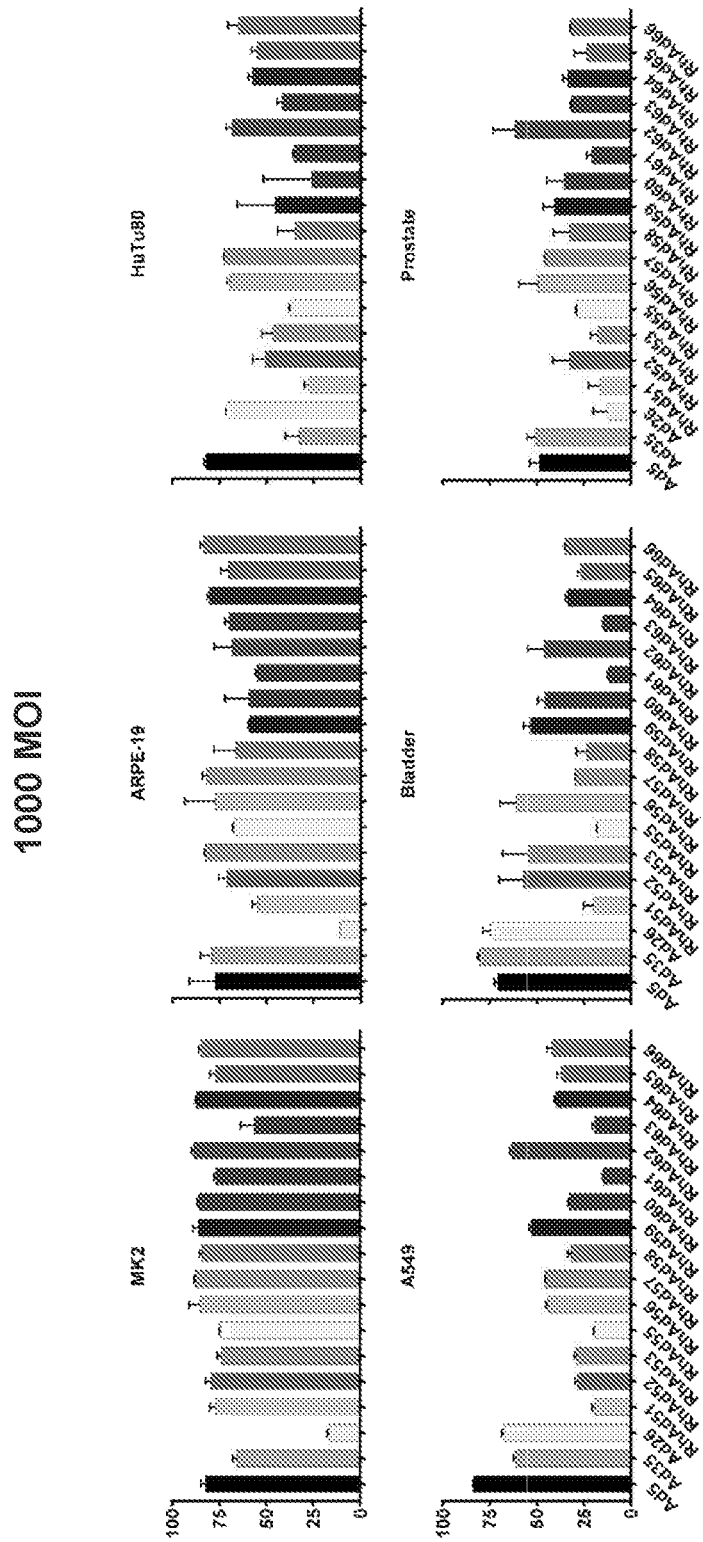
FIG. 6B is a series of graphs showing the tropism of adenovirus vectors in rhesus kidney cells (MK2), human retinal cells (ARPE-19), human duodenum adenocarcinoma cells (HuTu80), human lung carcinoma cells (A549), human primary prostate cells (prostate) and human primary bladder cells (bladder) at a multiplicity of infection (MOI) of 1000. Results were run on LSRII flow cytometer 24 hours post infection and plotted as percentage eGFP positive cells.

Tissue tropism and cellular receptors. We next assessed tissue tropism and receptor use in vitro. Human immortalized cell lines ARPE-19 (retinal), HuTu80 (duodenum adenocarcinoma), A549 (lung carcinoma), human primary bladder, and prostate cell lines, as well as the rhesus cell line MK2 (kidney) were infected with a multiplicity of infection (MOI) of 100 or 1000 virus particles per cell for 24 hours with vectors expressing eGFP and analyzed by flow cytometry. MK2 and ARPE-19 cells were transduced most efficiently for all vectors (FIGS. 6A and 6B). HuTu80 duodenum adenocarcinoma cells were transduced most efficiently by RhAd56, 57, 62, and 66, whereas A549 lung carcinoma cells were transduced best by RhAd56, 57, 59, and 62. Human primary bladder cells were optimally transduced by RhAd52, 53, 56, 59, 60, and 62 whereas primary prostate cells were infected most efficient by RhAd56, 57, 59, and 62.

Figure 6C:
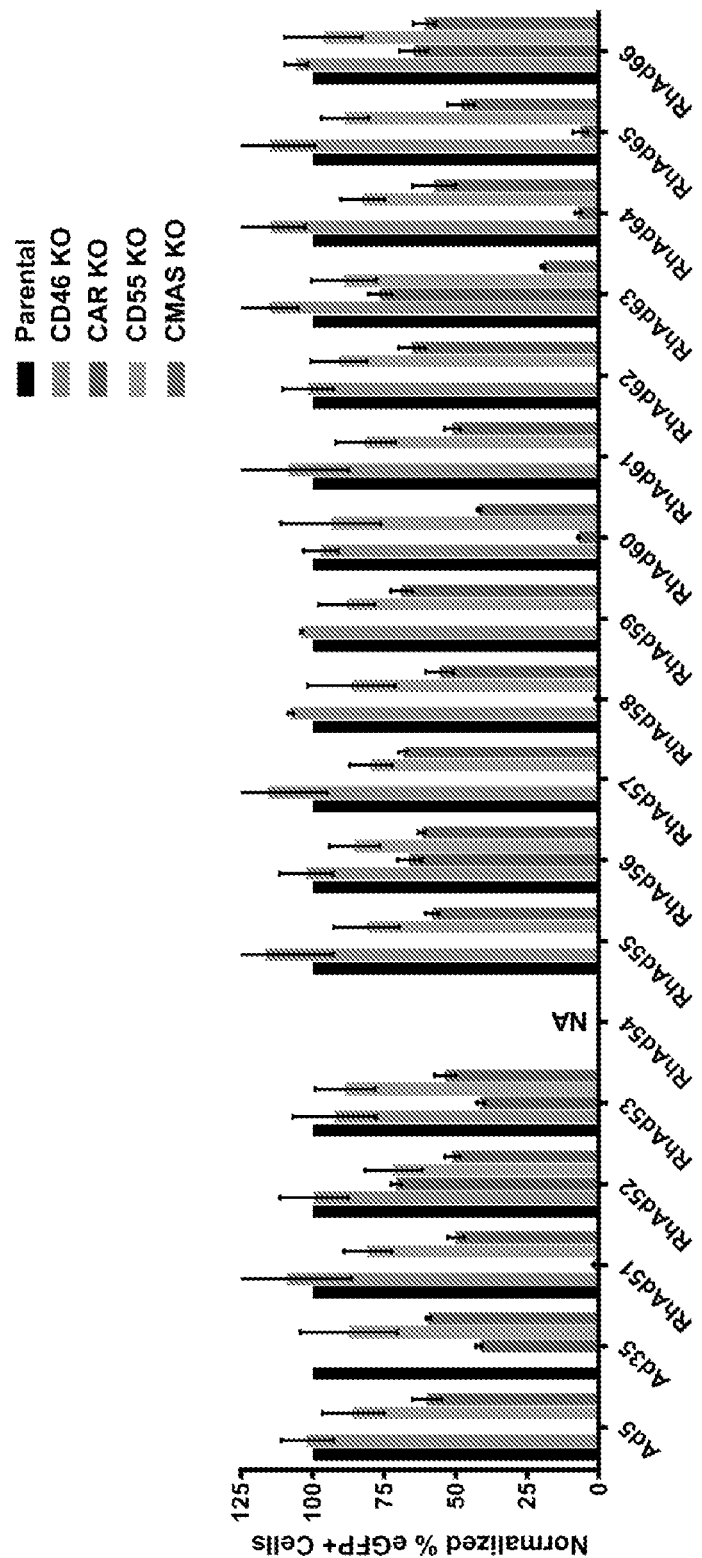
FIG. 6C is a graph showing receptor assessment in parental HAP1 cells (black), CD46 knockout cells (red), CAR knockout cells (blue), CD55 knockout cells (green) and sialic acid (CMAS) knockout cells (purple). Cells were incubated for 24 hours and analyzed by flow cytometry after an infection of 1 hour. Percentage of eGFP positive cells was normalized to 100 percent infection in parental cells. Reduced infection in the knockout cell lines suggests lack of available cellular entry receptor for the corresponding adenovirus.

Human adenoviruses often use the Coxsackie-adenovirus receptor (CAR) or CD46 as a primary cellular entry receptors (Zhang et al., *J Virol.* 79(19):12125-31, 2005). To assess receptor use by these RhAds, we used parental HAP1 cells as well as CAR, CD46, CD55 and sialic acid (CMAS) receptor knockout (KO) cell lines (Horizon). Cells were infected for 1 hour with Ad vectors expressing eGFP. After 24 hours cells were harvested and analyzed for eGFP positive cells (FIG. 6C). All values were normalized to 100% infection in parental HAP1 cells. Human Ad5 uses CAR as its primary cellular entry receptor, which was confirmed here by blockade of entry into the CAR KO cell line. Human Ad35 uses CD46, as shown here by blockade of entry into the CD46 KO cell line. RhAds 51, 55, 57, 58, 59, 61, and 62 were completely blocked from entry into the CAR KO cell line, suggesting CAR is their primary cell entry receptor. Partial block into CAR KO cells was observed for RhAds 60, 64, and 65 whereas minimal to no effect by CAR KO cells was seen for RhAds 52, 53, 56, 63, and 66. CD46 and CD55 did not appear to be used by any of the RhAd vectors and minor effects could be observed for all vectors in the sialic acid KO cells. RhAds 52, 53, 56, 63, and 66 were able to infect all of these cell lines, suggesting that they utilize other cell entry receptors.

Discussion

We isolated, constructed, and characterized 14 rhesus adenovirus vectors. We adapted Gibson assembly techniques for the rapid construction of these vectors. This method reduced the time of construction from over 2 months (Zhou et al., *Nature Protocols.* 5:1775-85, 2010) to approximately 1 week, and is generalizable and independent of restriction enzyme sites. These RhAd vectors exhibited very low seroprevalence in human populations and proved highly immunogenic in mice.

Figure 7:
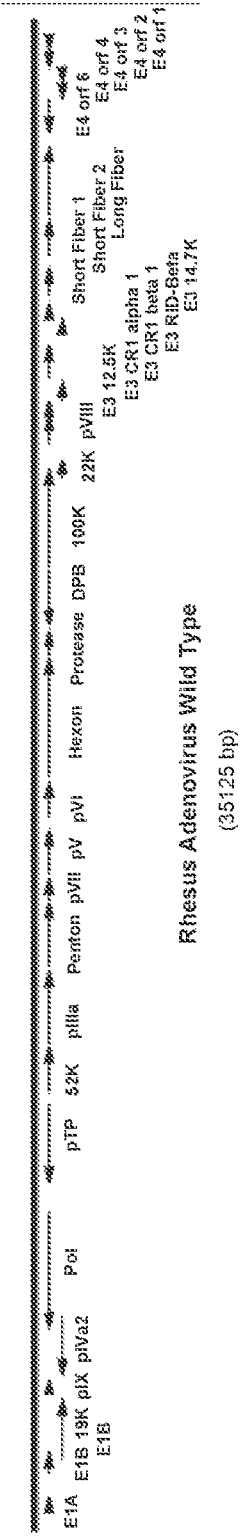
FIG. 7 is a schematic map of the genome organization of wild type rhesus adenovirus.
Figure 8:
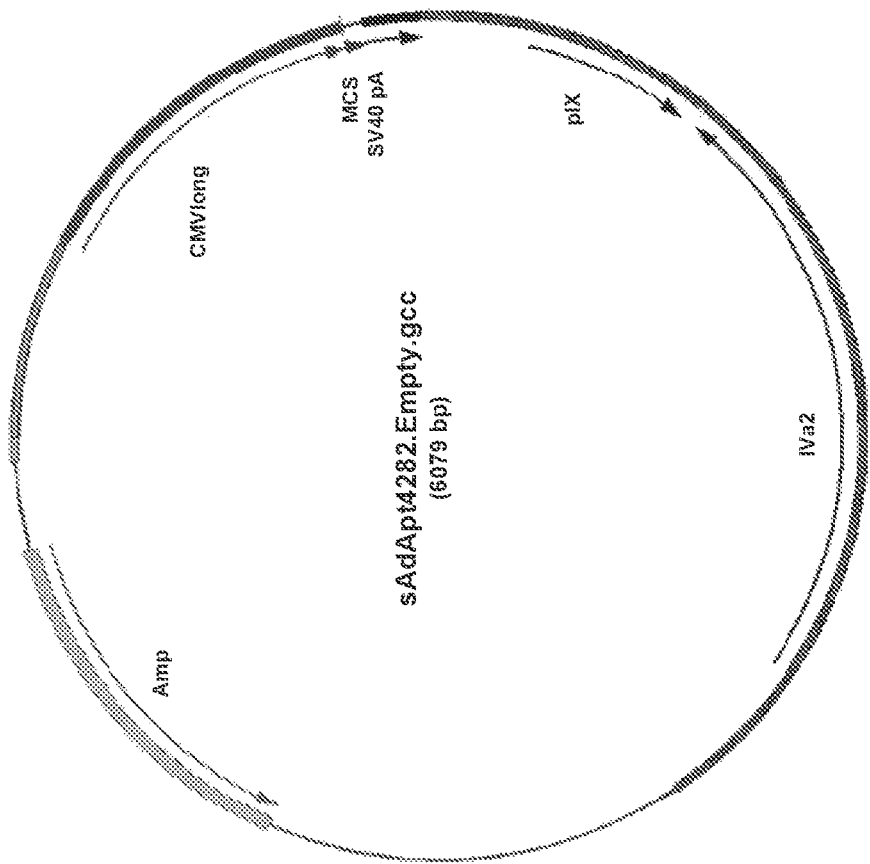
FIG. 8 is a schematic map of plasmid RhAdApt54. Empty (SEQ ID NO: 224), which contains the left ITR, E1 deletion, a Transgene Cassette (CMV promoter, multiple cloning site, SV40 polyA), and approximately 2.5 kb of the RhAd54 adenovirus genome starting before pIX.
Figure 9:
FIG. 9 is a schematic map of plasmid pWe/RhAd54.pIX-rITR.dE3 (SEQ ID NO: 225), which contains the remainder of the RhAd54 genome from pIX through rITR, but lacks the E3 region.

We previously reported the construction of 3 RhAd vectors (RhAd51-53) (Abbink et al., *J Virol.* 89(3):1512-22, 2015) and have demonstrated the protective efficacy of RhAd52 expressing ZIKV.M-Env against ZIKV challenge in rhesus monkeys (Abbink et al., *Science.* 353(6304):1129-32, 2016). The present work substantially expands this class of vectors. Similar to RhAd51-53, all 14 RhAds described here grouped with the poorly characterized species G, which is separate from nearly all the human and chimpanzee adenoviruses. Sequence analyses of the RhAd viral genomes identified an overall similar genome organization compared to existing human and chimpanzee adenoviruses, with the major genetic differences seen within the late genes that express the hexon, fiber, and penton proteins (FIG. 7). Interestingly, whereas the majority of human adenoviruses have a single fiber gene, all the rhesus adenoviruses described here have two or three different fiber genes.

Consistent with the large phylogenetic distance from human Ads, these RhAd vectors showed very low seroprevalence in Sub-Saharan African human sera compared to other human and chimpanzee Ad vectors, confirming previous findings with RhAd51-53 (Abbink et al., *J Virol.* 89(3):1512-22, 2015). In addition, a single dose of these RhAd vectors expressing SIVgag proved highly immunogenic in mice with antigen specific responses comparable to other human and chimpanzee Ad vectors.

Biologic differences among these RhAd vectors were observed by luminex and RT-Array. All RhAds triggered pro-inflammatory responses but with different levels of up- or downregulation of cytokines and chemokines, such as MIP1-α, MIP1β, TNF-α, IFN-γ, CXCL10, CCL7, and IL2, and distinct grouping of vectors could be detected. These differences suggest that certain innate phenotypes may be preferable for certain indications. These RhAd vectors also showed tropism for human cells with some variation among vectors. Nine out of 16 RhAds used CAR as primary cellular entry receptor, but additional receptors also likely exist.

In conclusion, we have substantially expanded the portfolio of rhesus adenovirus vectors using a rapid cloning method. These RhAd vectors are all part of species G and show characteristics of seroprevalence and immunogenicity that make them attractive as vaccine and gene transfer vectors.

Example 2. Administration of a Recombinant Adenovirus to a Human Subject Having or at Risk of an HIV-1 Infection A human subject identified as having or at risk of an HIV-1 infection may be administered a vector encoding a recombinant adenovirus described herein (e.g., a recombinant adenovirus derived from any one of RhAd54-RhAd67) that expresses a viral protein product (e.g., an HIV env protein). For example, the subject could be administered about $1\times10^3$ viral particles (vp)/dose to about $1\times10^{14}$ vp/dose of the adenoviral vector. The patient is then monitored for the presentation of symptoms of HIV infection or the resolution of symptoms. If necessary, one or more (e.g., 2, 3, 4, 5, 6, 7, 8, 9, 10, or more) additional doses of the recombinant adenovirus vector can be administered.

Example 3. Administration of a Recombinant Adenovirus to a Human Subject Having or at Risk of a Zika Infection A human subject identified as having or at risk of a Zika infection may be administered a vector encoding a recombinant adenovirus described herein (e.g., a recombinant adenovirus derived from any one of RhAd54-RhAd67) that expresses a viral protein product (e.g., a Zika env protein). For example, the subject could be administered about $1\times10^3$ viral particles (vp)/dose to about $1\times10^{14}$ vp/dose of the adenoviral vector. The patient is then monitored for the presentation of symptoms of Zika infection or the resolution of symptoms. If necessary, one or more (e.g., 2, 3, 4, 5, 6, 7, 8, 9, 10, or more) additional doses of the recombinant adenovirus vector can be administered.

Example 4. Administration of a Recombinant Adenovirus to a Human Subject Having a Cancer A human subject identified as having a cancer (e.g., breast cancer) may be administered a vector encoding a recombinant adenovirus described herein (e.g., a recombinant adenovirus derived from any one of RhAd54-RhAd67) that expresses a cancer antigen or tumor-associated antigen (e.g., a tumor-associated antigen listed in the Appendix). For example, the subject could be administered about $1\times10^3$ viral particles (vp)/dose to about $1\times10^{14}$ vp/dose of the adenoviral vector. The patient is then monitored for progression or treatment of the cancer. If necessary, one or more (e.g., 2, 3, 4, 5, 6, 7, 8, 9, 10, or more) additional doses of the recombinant adenovirus vector can be administered.

Example 5. Administration of a Recombinant Adenovirus with Three Fiber Proteins to a Human Subject Having an HIV-1 Infection A human subject identified as having or at risk of an HIV-1 infection may be administered a vector encoding a recombinant adenovirus having three fiber proteins described herein (e.g., a recombinant adenovirus derived from any one of RhAds 55, 57, 59-61, and 63-67) that expresses a viral protein product (e.g., an HIV env protein), e.g., in an amount of about $1\times10^3$ viral particles (vp)/dose to about $1\times10^{14}$ vp/dose. The patient is then monitored for the presentation of symptoms of HIV infection or the resolution of symptoms. If necessary, one or more (e.g., 2, 3, 4, 5, 6, 7, 8, 9, 10, or more) additional doses of the recombinant adenovirus vector can be administered.

Example 6. Immunogenicity and Cross-Reactivity of Rhesus Adenoviral Vectors

We investigated the immunogenicity and vector-specific cross-reactivity of a panel of RhAd vectors. We show that RhAd vectors potently induce both humoral and cellular immune responses and that RhAd vectors were unaffected by high levels of pre-existing HuAd-specific immunity. We also assessed the extent of humoral and cellular cross-reactivity between RhAd and HuAd vectors and between different RhAd vectors. Our data support the use of RhAd vectors as vaccine compositions (e.g., human vaccine compositions) and in robust heterologous prime-boost regimens.

Materials and Methods

Phylogenetic Trees. Phylogenetic trees were constructed using MEGA 7 (www.megasoftware.net). Whole genome and hexon DNA sequences were aligned using ClustalW. Maximum likelihood phylogenetic trees were based on the General Time Reversible model and were bootstrapped 50 times. The trees with the highest log likelihoods are shown. The tree is drawn to scale, with branch lengths measured in the number of substitutions per site.

Mice and immunizations. Female C57BL/6 mice (Jackson Laboratories) were used for all immunization experiments. Mice were vaccinated with E1/E3-deleted Ad5, Ad26, ChAd24, RhAd52, RhAd53, or RhAd56 vectors. Vectors were either empty (containing no transgene) or expressed $SIV_{mac}239$ Gag or HIV-1 clade C Env 459C gp140 (Bricault et al., *J. Virol.* 89(5):2507-19, 2015) transgenes and were injected intramuscularly in the quadriceps at a dose of $10^9$ viral particles in a volume of 100 µL divided equally between the two legs. All animal experiments were performed in accordance with Beth Israel Deaconess Medical Center Institutional Animal Care and Use Committee guidelines.

ELISA. Enzyme-linked immunosorbant assays (ELISAs) were performed as described previously (25). Briefly, ELISA plates (ThermoScientific) were coated overnight at 4° C. with HIV-1 clade C Env 459C gp140. The following day, mouse serum was added to the plates and serially diluted. After a one-hour incubation, HRP-conjugated rabbit anti-mouse secondary antibody (Jackson ImmunoResearch Laboratories) was added to the plates for another one-hour incubation. Finally, plates were developed and analyzed using the SPECTRAMAX™ Plus ELISA plate reader (Molecular Devices) and Softmax Pro-6.5.1 software. End-point titers were determined to be positive at the highest dilution that maintained an absorbance greater than 2-fold above the background levels.

Mouse tissue processing and flow cytometry. Mice were bled submandibularly and PBMCs from whole blood were isolated using Ficoll-Hypaque density centrifugation at 1900 RPM for 20 minutes. Spleens were processed as previously described (Provine et al., *J. Immunol.* 192(11):5214-25, 2014). MHC class I tetramer staining was performed using $H-2D^b$ tetramer loaded with the immunodominant ALI 1 peptide (AAVKNWMTQTL) as described previously (Provine et al., *J. Immunol.* 192(11):5214-25, 2014). Biotinylated class I monomer was provided by the National Institutes of Health Tetramer Core Facility (Emory University, GA). PBMCs were surfaced stained with anti-PD-1 (RMP1-30), anti-CD8a (53-6.7), anti-CD44 (IM7), and anti-KLRG1 (2F1).

Splenocytes were stimulated with 1 µg/mL of an overlapping $SIV_{mac}239$ Gag peptide pool. At the time of stimulation, Brefeldin A (BD Biosciences) was added and samples were incubated for 5 hours at 37° C. After the incubation, cells were washed and stained with the surface stain antibodies (mentioned above) and permeabilized with Cytofix/Cytoperm (BD Biosciences) and stained with anti-IFN-γ (XMG1.2) antibodies for half an hour. Vital exclusion dye was purchased from Invitrogen. All antibodies were purchased from either BioLegend or BD Biosciences. All samples were acquired using an LSR II flow cytometer (BD Biosciences) and data were analyzed using FlowJo version 9.6.4 (Tree Star).

Neutralization assays. Adenovirus-specific neutralization antibody (NAb) titers using mouse serum samples were conducted as previously described (Sprangers et al., *J. Clin. Microbiol.* 41(11):5046-52, 2003). Briefly, serum was 2-fold serially diluted in a 96-well flat bottom plate with the exception of the last column that served as the maximum infection control. Replication-incompetent rAd-Luc reporter construct viruses were added to the plate followed by the addition of A459 cells. Plates were incubated for 24 hours at 37° C. 10% $CO_2$. After incubation, the media was removed and 100 μl of Phosphate-buffered saline (PBS) and 100 μL of Steady-Glo substrate (Promega) were added to the wells. Luciferase activity was measured in the cells with a Victor 3 multilabel counter (PerkinElmer, Waltham, Mass.). Neutralization titers were defined as the maximum serial dilution where 90% of the virus was neutralized by the serum.

Results

Figure 55B:
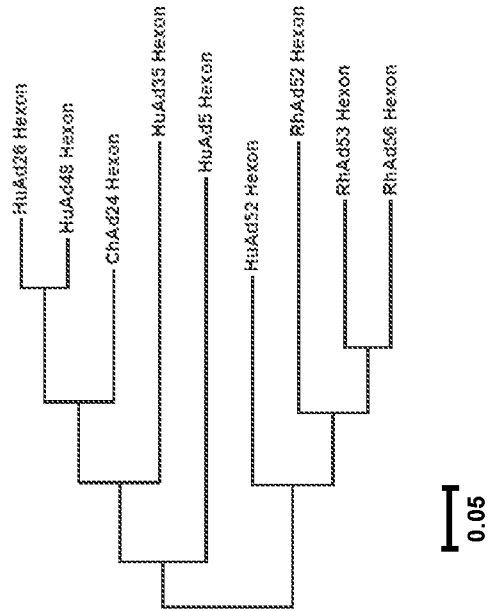
FIGS. 55A and 55B present two phylogenetic trees showing full genome (left) and hexon (right) relationships among various human adenoviruses (HuAds), ChAd24, RhAd52, RhAd53, and RhAd56.
Figure 55A:
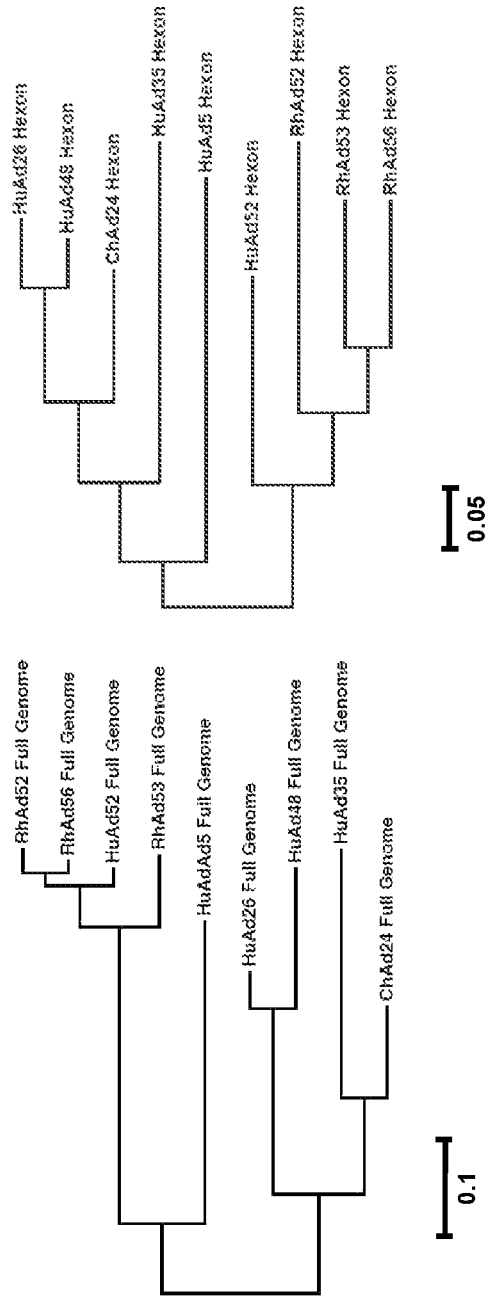

Cellular immune phenotypes induced by rhesus adenoviruses. We investigated the immunogenicity of a panel of RhAd vectors in comparison with the chimpanzee Ad24 (ChAd24) and human Ad5 and Ad26 vectors (FIGS. 55A and 55B). Groups of C57BL/6 mice (n=8-12/group) were injected intramuscularly (i.m.) with $10^9$ viral particles (vp) of ChAd24-Gag, RhAd52-Gag, RhAd53-Gag, RhAd56-Gag, Ad5-Gag, or Ad26-Gag, and cellular immune responses were assessed by $D^b$/AL11 tetramer binding and intracellular staining (ICS) assays (as described in Provine et al., *J. Immunol.* 192(11):5214-25, 2014).

Figure 56A:
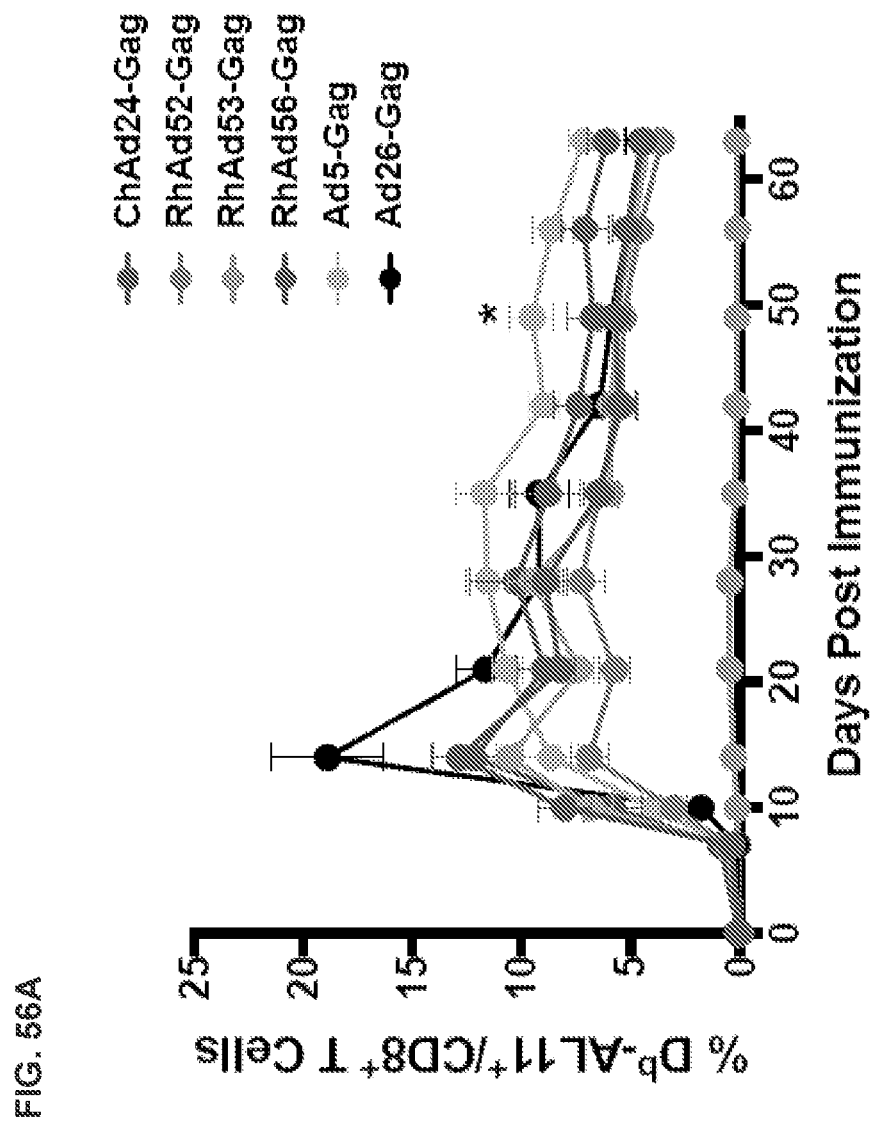
FIGS. 56A-56C are a series of graphs showing the longitudinal analysis of $D^b$/AL11 tetramer positive (FIG. 56A), PD-1$^+$ (FIG. 56B), and KLRG1$^+$ CD8$^+$ T cells (FIG. 56C) from PBMCs. Mice were immunized IM with $10^9$ vp of the indicated adenoviral vectors. n=8-12 mice per group. Error bars indicate standard error of the mean (SEM).
Figure 56B:
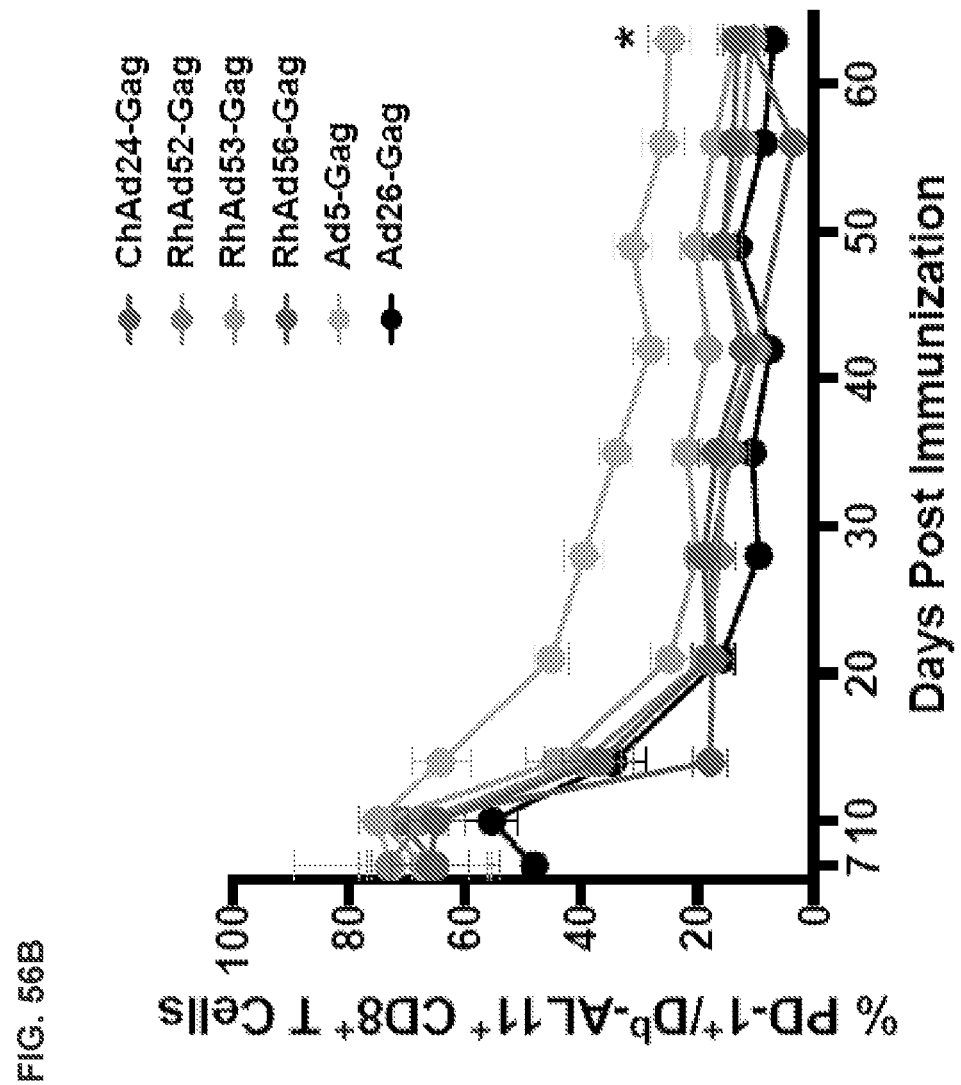
Figure 56C:
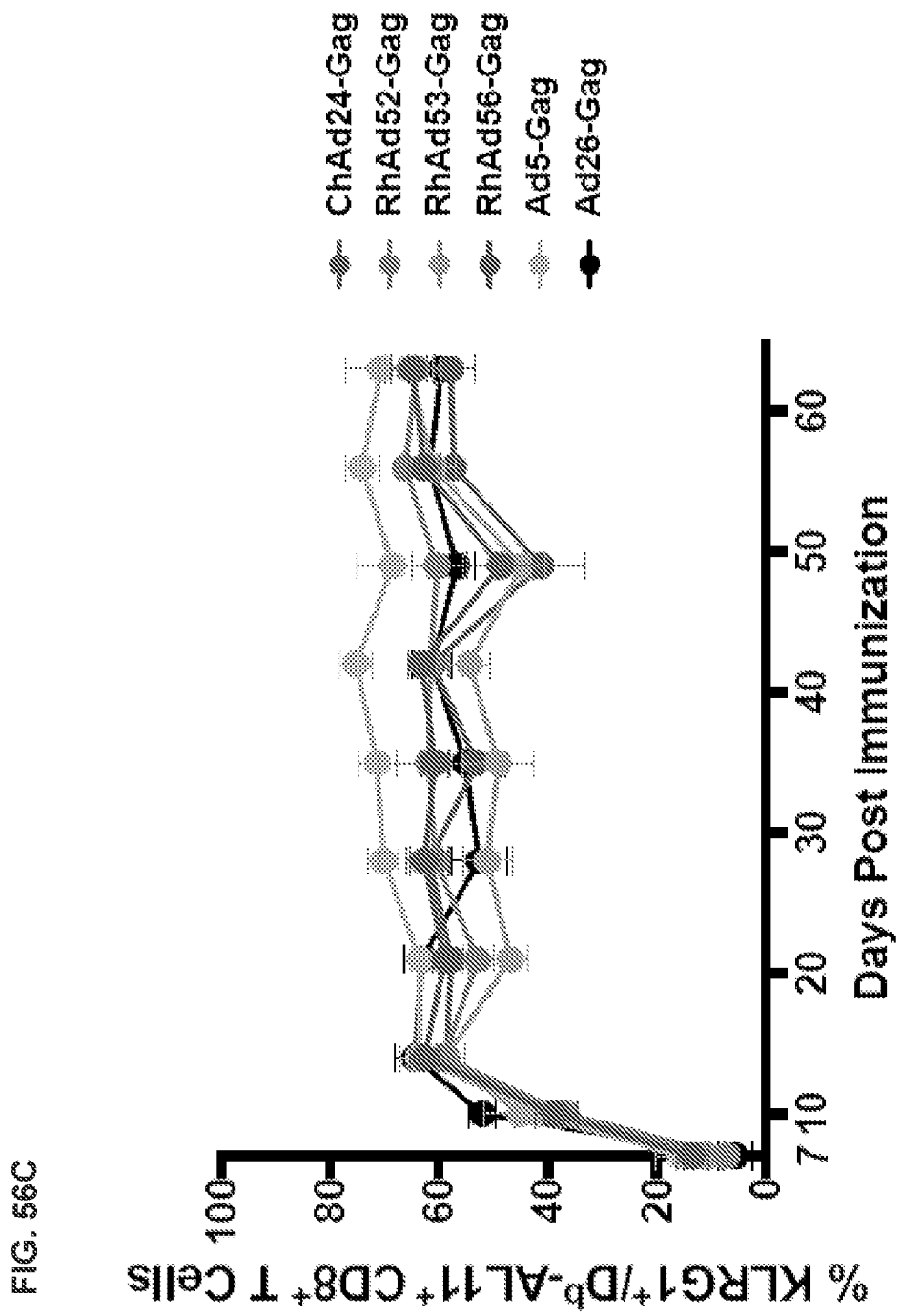
Figure 57A:
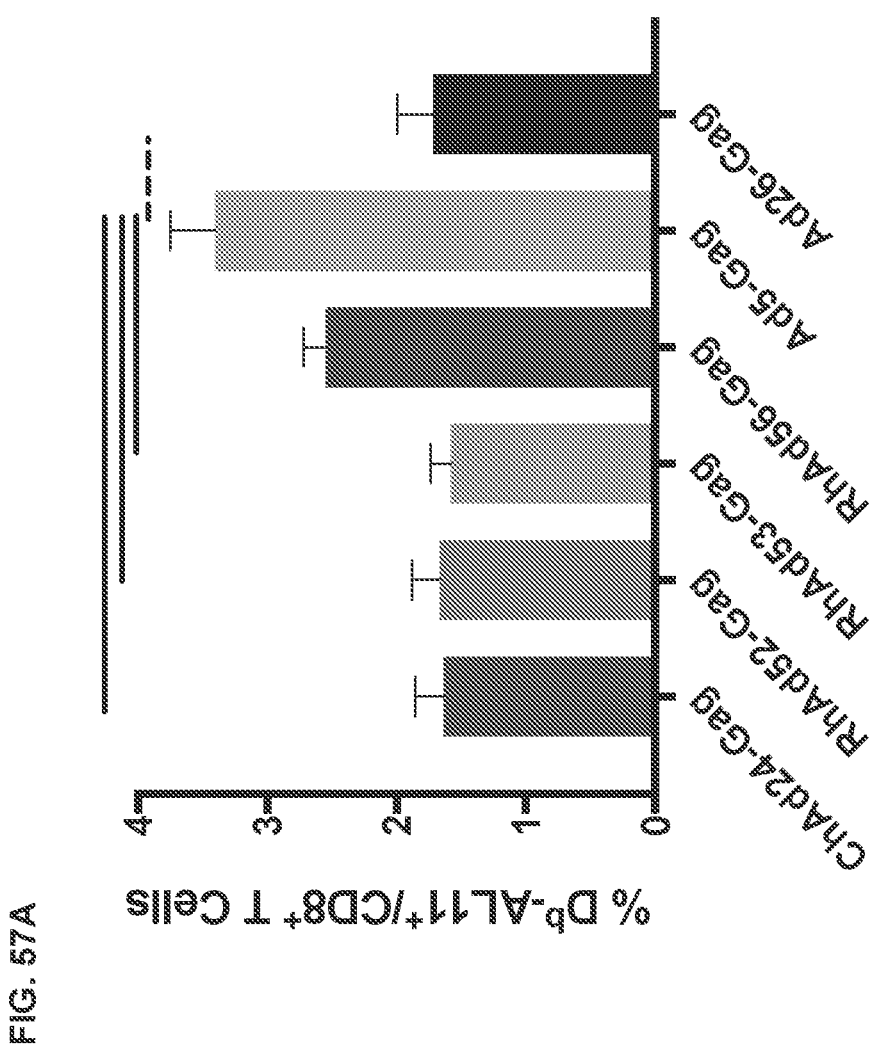
FIGS. 57A-57C are a series of graphs showing the frequency of $D^b$/AL11 (FIG. 57A), PD-1$^+$ (FIG. 57B), and KLRG1$^+$ CD8$^+$ T cells (FIG. 57C) from splenocytes. Mice were immunized IM with $10^9$ vp of the indicated adenoviral vectors. n=8-12 mice per group. Lines above graphs denote significance: solid bars, P<0.0001, dotted lines, P<0.01. Error bars indicate standard error of the mean (SEM).
Figure 57B:
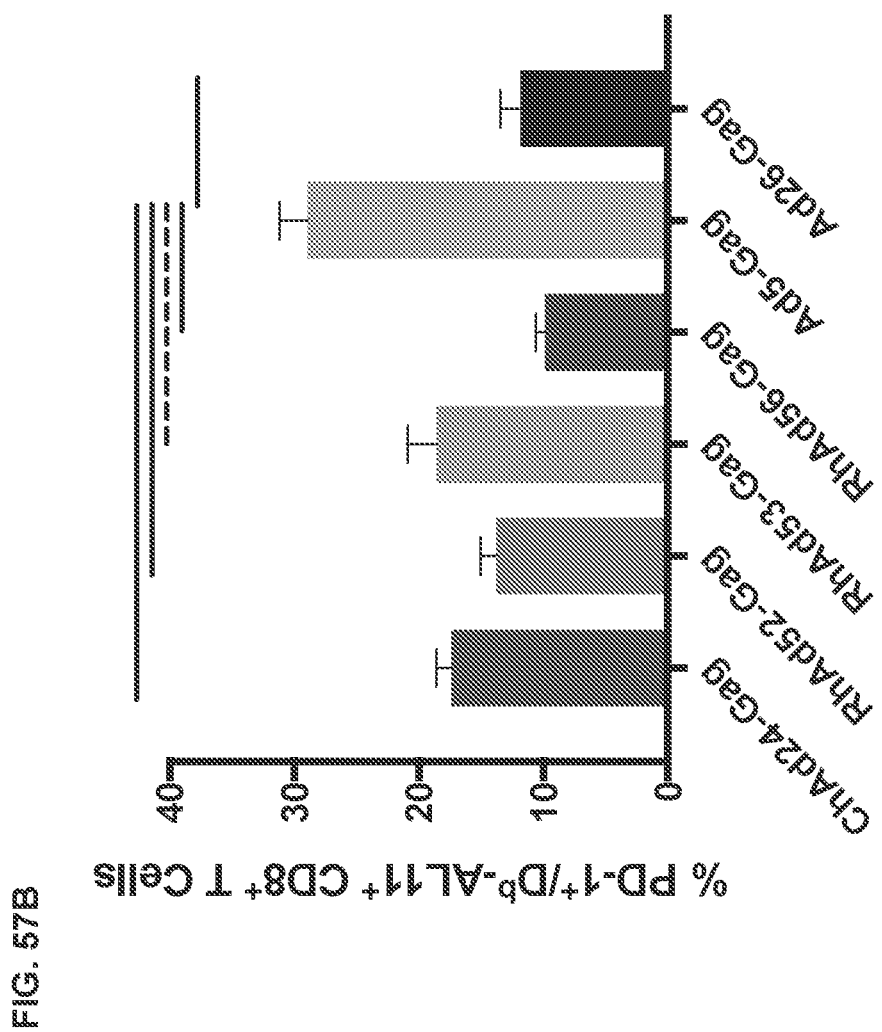
Figure 57C:
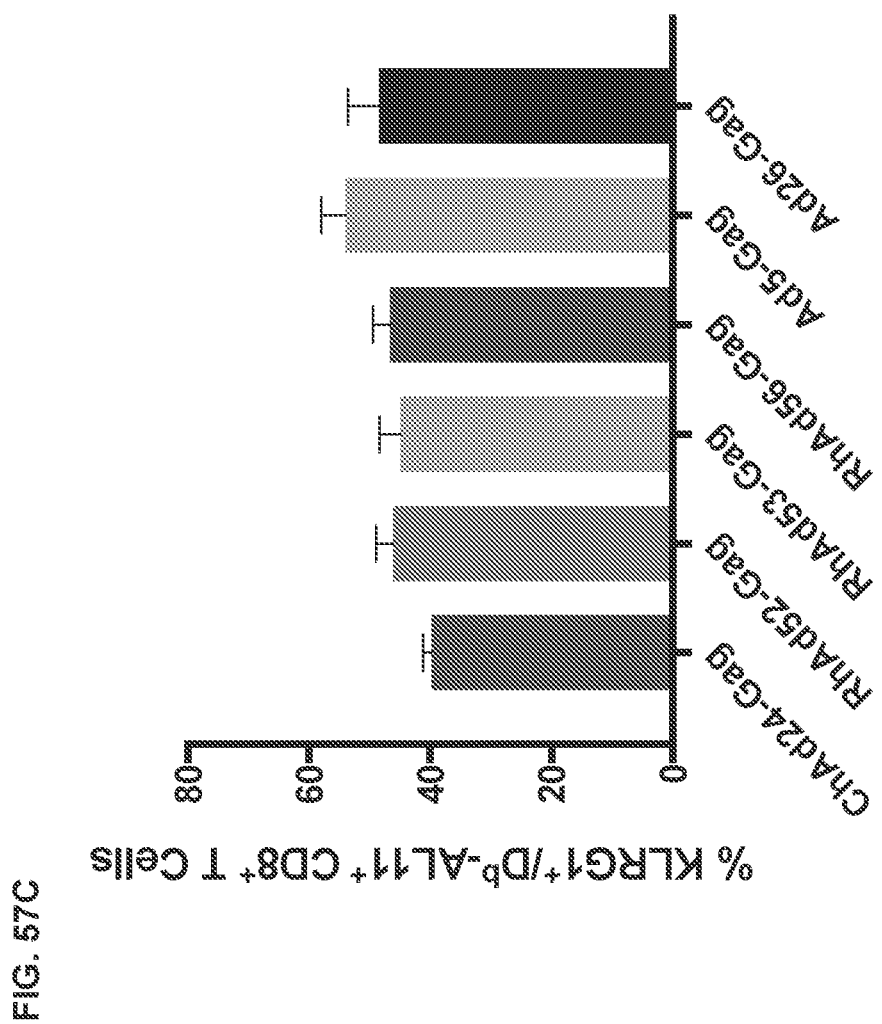
Figure 58:
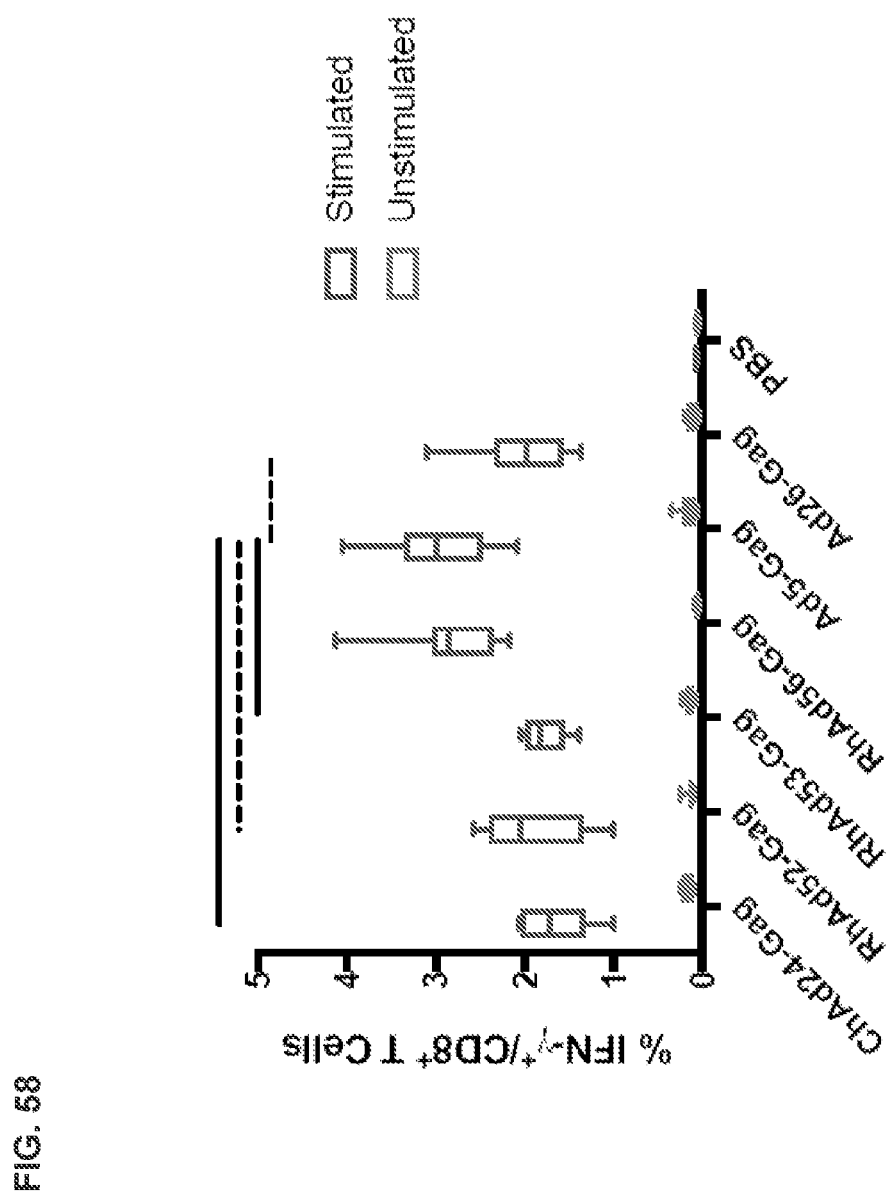
FIG. 58 is a graph showing the frequency of IFN-$\gamma^+$ CD8$^+$ T cells from splenocytes. Blue bars indicate splenocytes stimulated with SIVmac239 gag peptide pool and red bars are unstimulated samples. Box and whisker plots indicate min and max values. Mice were immunized IM with $10^9$ vp of the indicated adenoviral vectors. n=8-12 mice per group. Lines above graphs denote significance: solid bars, P<0.0001, dotted lines, P<0.01. Error bars indicate standard error of the mean (SEM).

As shown in FIG. 56, all vectors were immunogenic, although Ad5-Gag induced the highest frequency of $D^b$/AL11$^+$ CD8$^+$ T cells at set point after day 28 with a mean of 9.5% tetramer-positive CD8$^+$ T cells at day 49 compared to a mean of 5.3%-6.7% for all other vectors (Ad5-Gag vs. Ad26-Gag, RhAd52-Gag, RhAd53-Gag, and ChAd24-Gag, P<0.01). However, Ad26-Gag, ChAd24-Gag and all RhAd-Gag vectors expressed lower levels of the exhaustion marker PD-1 (3.6-17.1%) than did Ad5-Gag (25.9%) at the terminal time point (Ad5-Gag vs. all other vectors, P<0.03). Moreover, Ad5-Gag vaccination resulted in higher expression of KLRG1$^+$ vaccine-elicited T cells than Ad26-Gag, ChAd24-Gag, and RhAd-Gag vectors, which suggests a more effector-like, rather than memory-like, phenotype. Responses in the spleen were similar to PBMCs on day 63 (FIG. 57). ICS on splenocytes also showed that Ad5-Gag and RhAd56-Gag induced the highest frequencies of IFN-γ$^+$ CD8$^+$ T cells (FIG. 58). These data suggest that the RhAd vectors induce T cells with a phenotype similar to Ad26 and different than the high frequency, exhausted, effector phenotype T cells induced by Ad5.

Figure 59A:
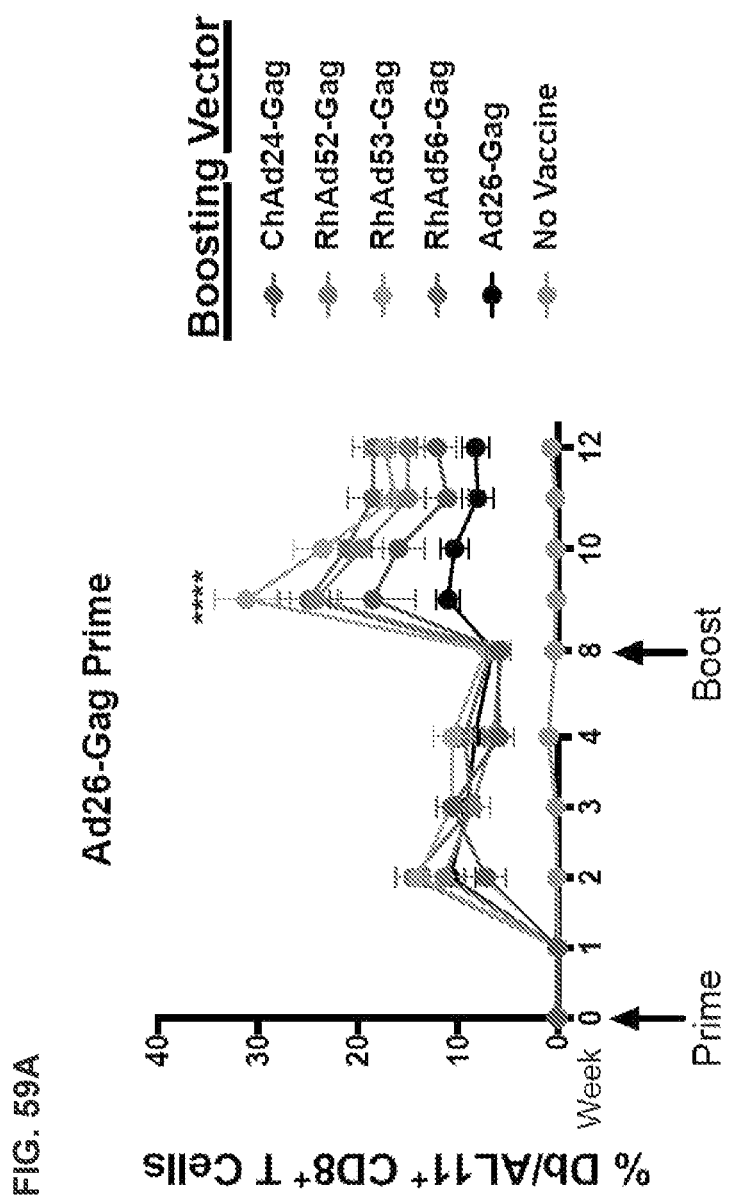
FIGS. 59A and 59B are two graphs showing the longitudinal analysis of $D^b$/AL11$^+$ CD8$^+$ T cells in PBMCs of vaccinated mice. C57BL/6 mice (n=8-10/group) were primed with $10^9$ vp of indicated adenoviral vector (Ad26-Gag prime in FIG. 59A and RhAd52-Gag Prime in FIG. 59B). After 8 weeks, mice were boosted with the vector shown in the legend. Ad26 prime: RhAd53 versus Ad26 (****, P<0.0001); RhAd53 versus ChAd24 (*, P=0.0464); RhAd52 prime: RhAd53 versus Ad26 (*, P=0.0142).
Figure 59B:
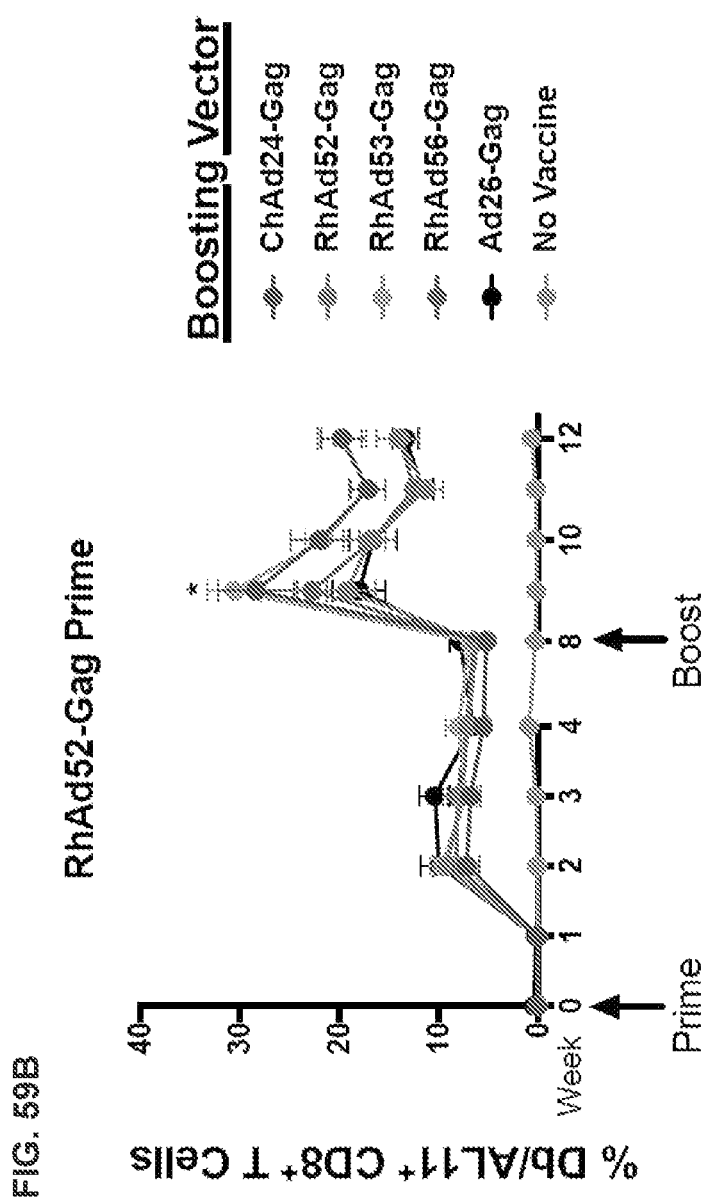

Cellular immunogenicity of RhAd vectors in prime-boost regimens. We evaluated the immunogenicity of HuAd/RhAd and RhAd/RhAd heterologous prime-boost vaccine regimens. Groups of C57BL/6 mice (n=40-50) were primed with $10^9$ vp Ad26-Gag or RhAd52-Gag at week 0. At week 8, mice were boosted (n=8-10/group) with $10^9$ vp of ChAd24-Gag, RhAd52-Gag, RhAd53-Gag, RhAd56-Gag, or Ad26-Gag, and CD8$^+$ T cell responses were assessed by $D^b$/AL11 tetramer binding assays. As shown in FIG. 59, mice primed with Ad26-Gag were not boosted efficiently by Ad26-Gag due to anti-vector pre-existing immunity generated by the priming immunization. In contrast, mice primed with Ad26-Gag were robustly boosted with ChAd24-Gag, RhAd52-Gag, RhAd53-Gag, and RhAd56-Gag. In Ad26-Gag primed mice, the RhAd53-Gag boost induced the highest peak responses of 31.1% at week 9, followed by RhAd52-Gag and RhAd56-Gag. These data show the potency of HuAd/RhAd vaccine regimens. In RhAd52-Gag primed mice, the RhAd53-Gag and ChAd24-Gag vectors induced the highest responses post-boost of 30.5% and 28.4% respectively at week 9 (RhAd53-Gag vs. Ad26-Gag, P=0.0142; ChAd24-Gag vs. Ad26-Gag, P=0.0625), followed by RhAd56-Gag, RhAd52-Gag, and Ad26-Gag. These data demonstrate the potency of RhAd/ChAd and RhAd/RhAd vaccine regimens.

Figure 60:
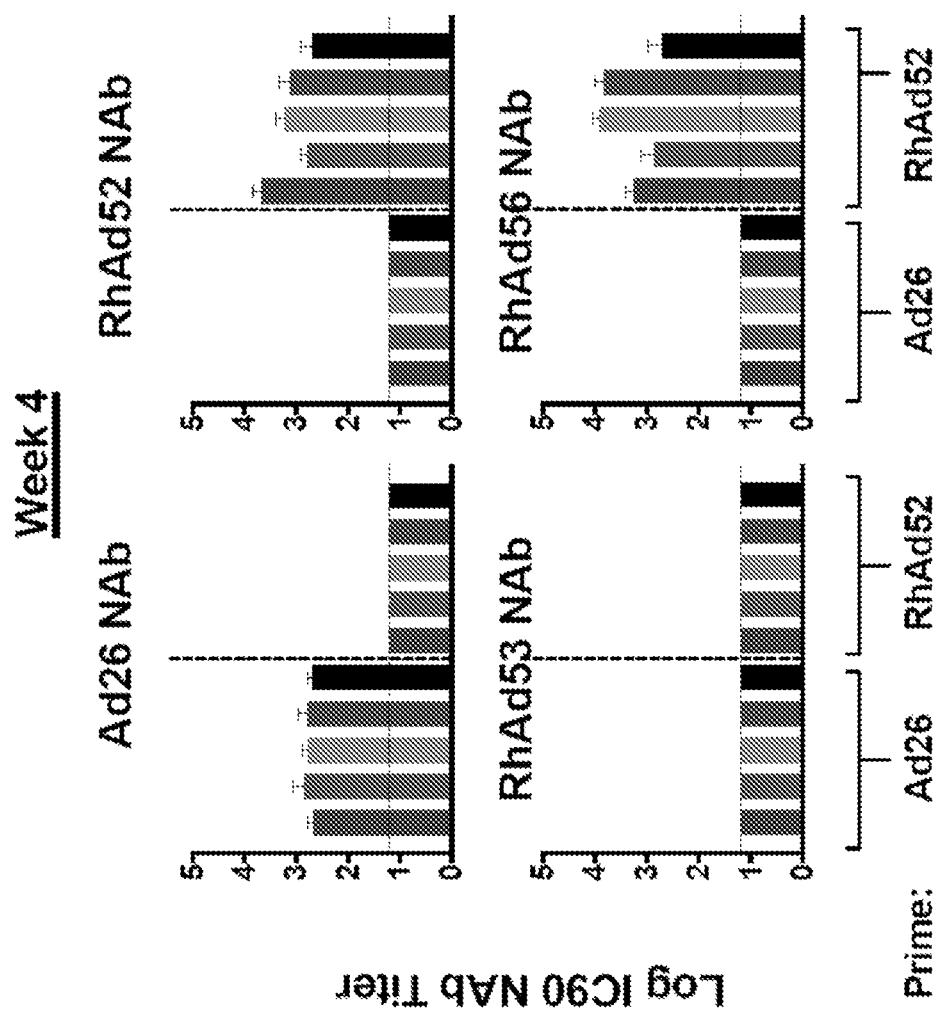
FIG. 60 is a series of graphs showing Ad-specific neutralization titers 4 weeks after prime, before boosting vaccinations were administered. C57BL/6 mice (n=4-8/group) were primed with $10^9$ vp of the indicated adenoviral vector. After 8 weeks, mice were boosted with the vector shown in the legend.
Figure 61:
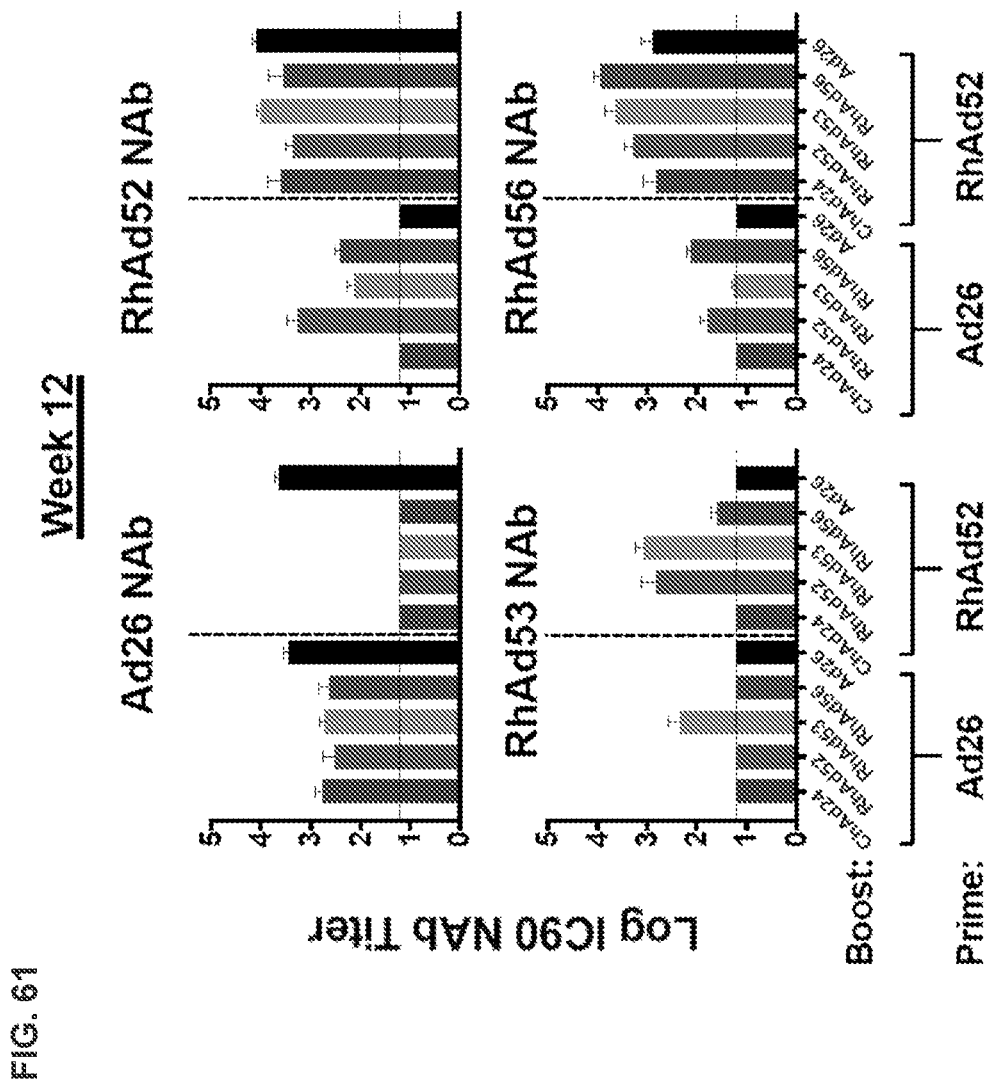
FIG. 61 is a series of graphs showing Ad-specific neutralization titers four weeks after the boosting vaccinations were administered. Dotted lines indicate limit of detection. Error bars indicate standard error of the mean (SEM). C57BL/6 mice (n=4-8/group) were primed with $10^9$ vp of indicated adenoviral vector. After 8 weeks, mice were boosted with the vector shown in the legend.

We assessed NAb titers to Ad26, RhAd52, RhAd53, and RhAd56 following immunization with these vectors. Four weeks post-prime, only Ad26-Gag primed mice had Ad26 NAb titers, as expected (FIG. 60). In contrast, mice primed with RhAd52-Gag had detectable NAb titers against both RhAd52 and RhAd56, indicating a degree of cross-reactive humoral immunity between RhAd52 and RhAd56 (FIG. 60). Similarly, at four weeks post-boost, we observed that only mice receiving an Ad26-Gag priming or boosting induced Ad26-specific NAb titers (FIG. 61). We observed cross-reactive NAb titers among mice boosted with RhAd52-Gag, RhAd53-Gag, and RhAd56-Gag. RhAd52/RhAd52 vaccinated mice generated detectable NAb titers to RhAd53, although RhAd52/RhAd53 generated higher RhAd53-specific NAbs. These data suggest similar potency of HuAd-RhAd and RhAd-RhAd prime-boost vaccine regimens despite a degree of cross-reactivity among RhAds.

Figure 62:
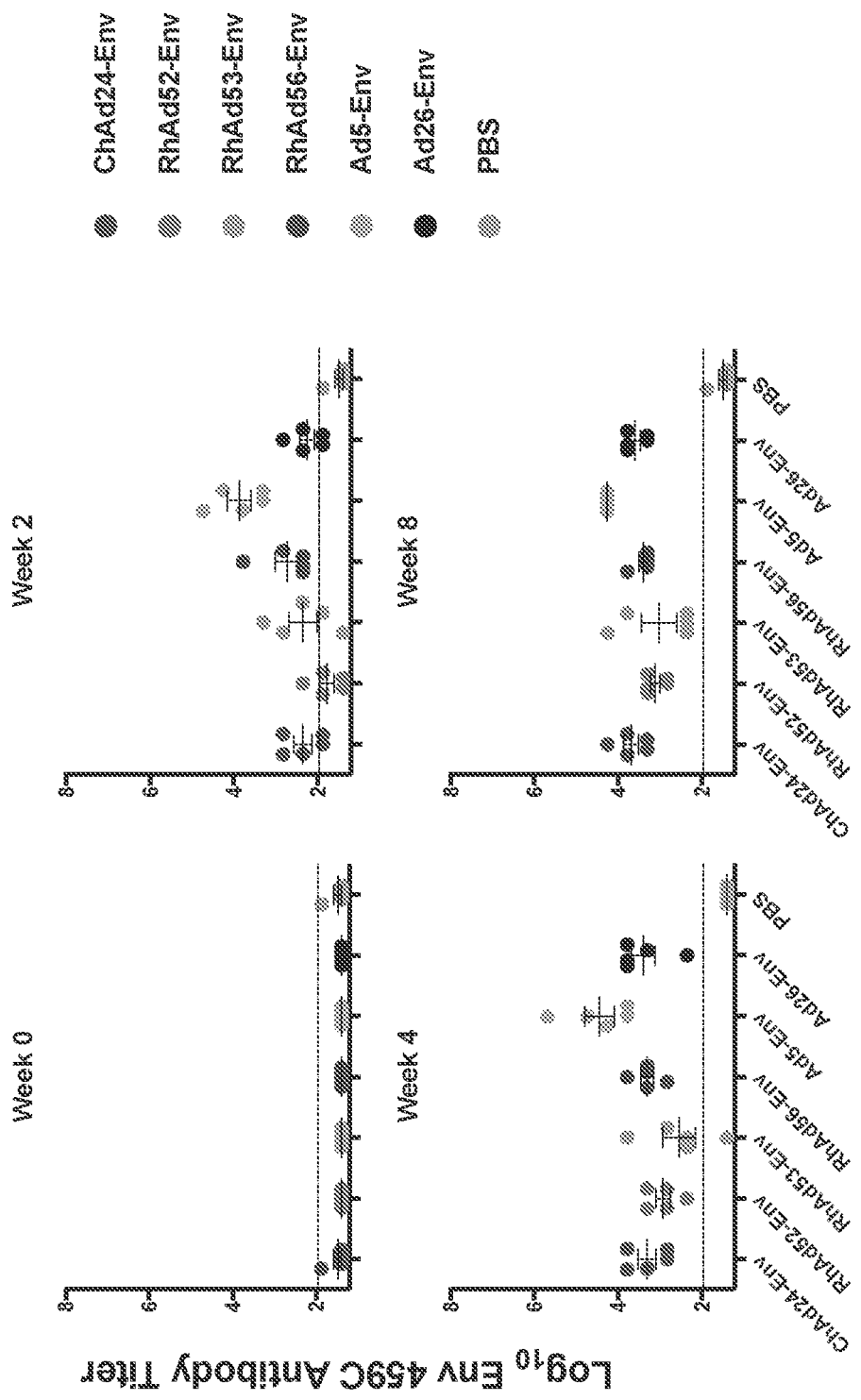
FIG. 62 is a series of graphs showing antibody binding titers on weeks 0, 2, 4, and 8 after vaccination following immunization of C57BL/6 mice with $10^9$ vp of the indicated adenoviral vectors (n=5/group). Dots represent individual animals. Lines above graphs denote significance: dotted lines, P<0.01. Error bars indicate standard error of the mean (SEM).
Figure 63:
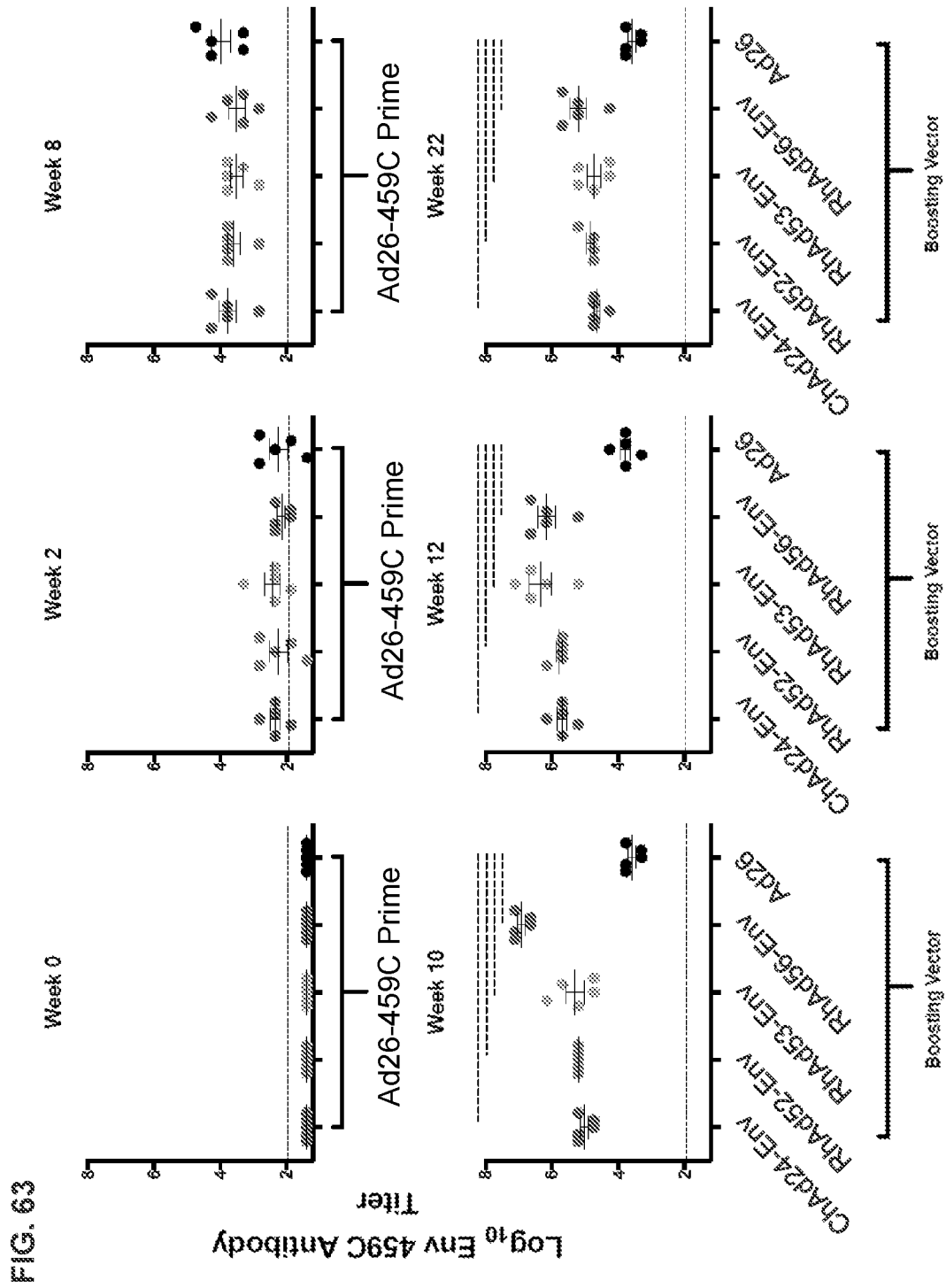
FIG. 63 is a series of graphs showing RhAd vector induced antibody binding titers. C57BL/7 mice were primed with Ad26-Env and 8 weeks later were boosted with the indicated adenoviral vectors (n=5/group). Antibody binding titers are shown for weeks 0, 2, and 8 post-prime and weeks 10, 12, and 22 post-boost. Dots represent individual animals. Lines above graphs denote significance: dotted lines, P<0.01. Error bars indicate standard error of the mean (SEM).

Humoral immunogenicity of RhAd vectors in prime-boost regimens. To investigate the ability of RhAds to induce humoral immunity to encoded transgenes, C57BL/6 mice (n=5/group) were immunized with ChAd24-Env, RhAd52-Env, RhAd53-Env, RhAd56-Env, Ad5-Env, or Ad26-Env encoding HIV-1 clade C Env 459C gp140 (Bricault et al., *J. Virol.* 89(5):2507-19, 2015). As shown in FIG. 62, after a single injection, all vectors induced Env-specific binding antibodies, although Ad5-Env induced faster kinetics and peak titers than the other vectors (FIG. 62). To evaluate prime-boost regimens, C57BL/6 mice (n=5/group) were primed with Ad26-Env at week 0 and boosted with ChAd24-Env, RhAd52-Env, RhAd53-Env, RhAd56-Env, or Ad26-Env at week 8. As shown in FIG. 63, all groups had similar levels of Env-binding antibody titers post-prime as expected. The Ad26-Env boost did not increase titers efficiently presumably as a result of anti-vector immunity induced by the priming immunization. In contrast, all of the RhAds efficiently boosted antibody titers. In particular, the Ad26-Env/RhAd56-Env regimen elicited the highest peak antibody titers of 6.93 mean $\log_{10}$ titer at week 10 (Ad26-Env vs. all other vectors, P=0.0079) (FIG. 63). These data demonstrate that RhAd vectors induce antibody responses, both alone and in the context of prime-boost regimens.

Effects of HuAd5 pre-existing immunity on RhAd vectors. Prior to our studies, the extent of immunologic cross-reactivity between Ad5 and RhAd vectors was not known, although it was previously reported that pre-existing Ad5 immunity can impede immune responses generated by certain non-human adenovirus vectors (Fitzgerald et al., *J. Immunol.* 170:1416-1422, 2003). As baseline Ad5 seroprevalence is nearly universal in the developing world (Abbink et al., *J. Virol.* 81(9):4654-63, 2007; Limbach et al., *Malar. J.* 16(1):263, 2017), we sought to evaluate whether high levels of Ad5 pre-existing immunity would impact RhAd vector immunogenicity.

Figure 64:
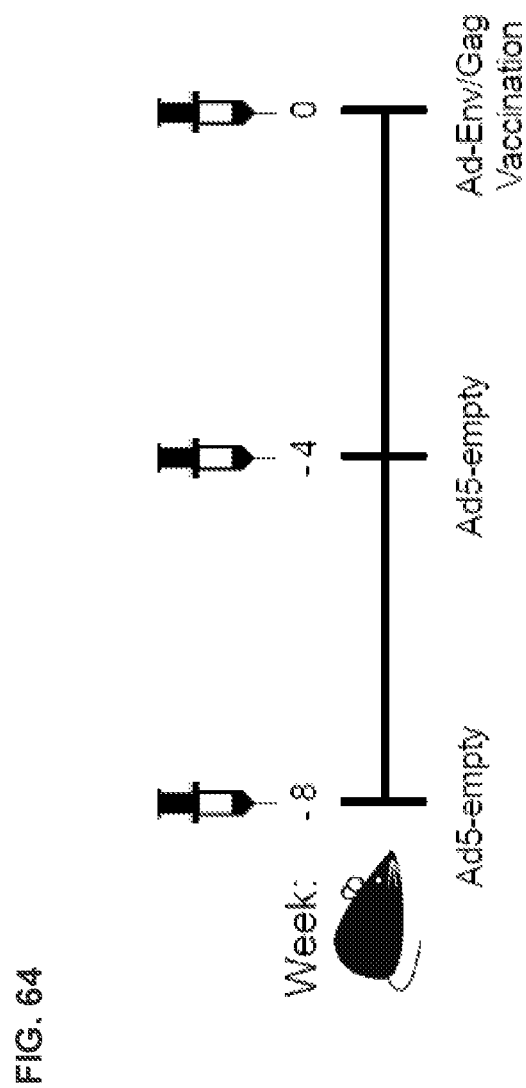
FIG. 64 is a schematic showing the experimental design for a study of RhAd vector immunogenicity in mice with baseline Ad5 immunity. C57BL/6 mice (n=50) were immunized at week −8 and week −4 with $10^9$ vp of Ad5-empty. At week 0, mice were injected with a heterologous Ad vector expressing either Gag or Env (n=5/group), as shown in FIGS. 65-67.
Figure 65A:
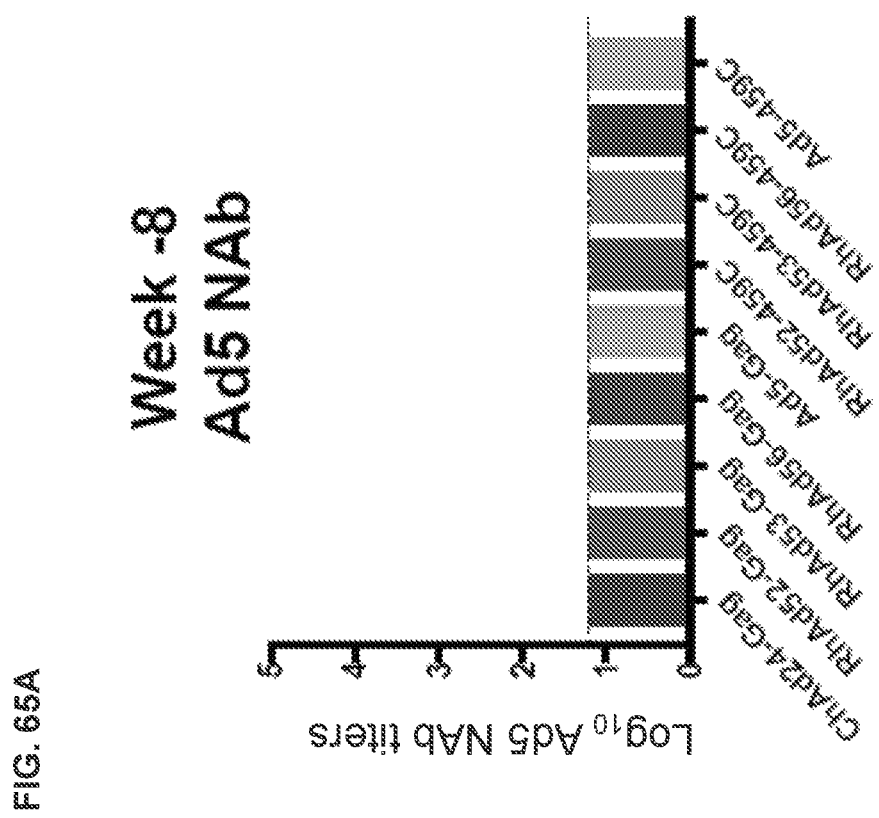
FIGS. 65A-65C is a series of graph showing Ad5 neutralizing antibody titers at weeks −8, −4, and 0 following the immunization regimen shown in FIG. 64. Error bars indicate standard error of the mean (SEM). C57BL/6 mice (n=50) were immunized at week −8 and week −4 with $10^9$ vp of Ad5-empty. At week 0, mice were injected with the indicated vector either expressing Gag or Env (n=5/group).
Figure 65B:
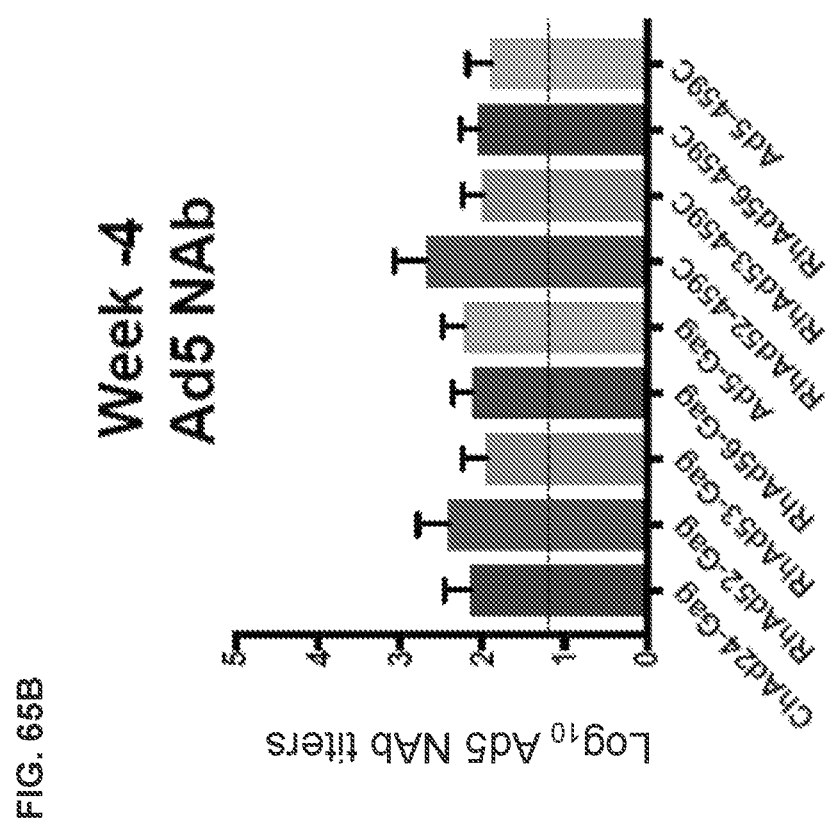
Figure 65C:
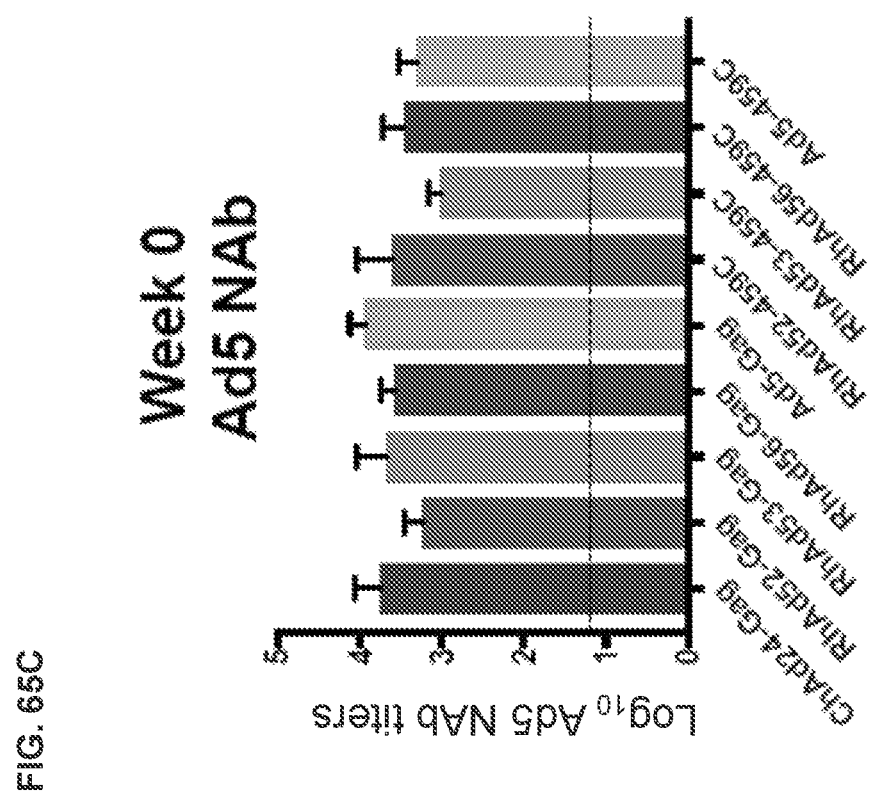
Figure 66:
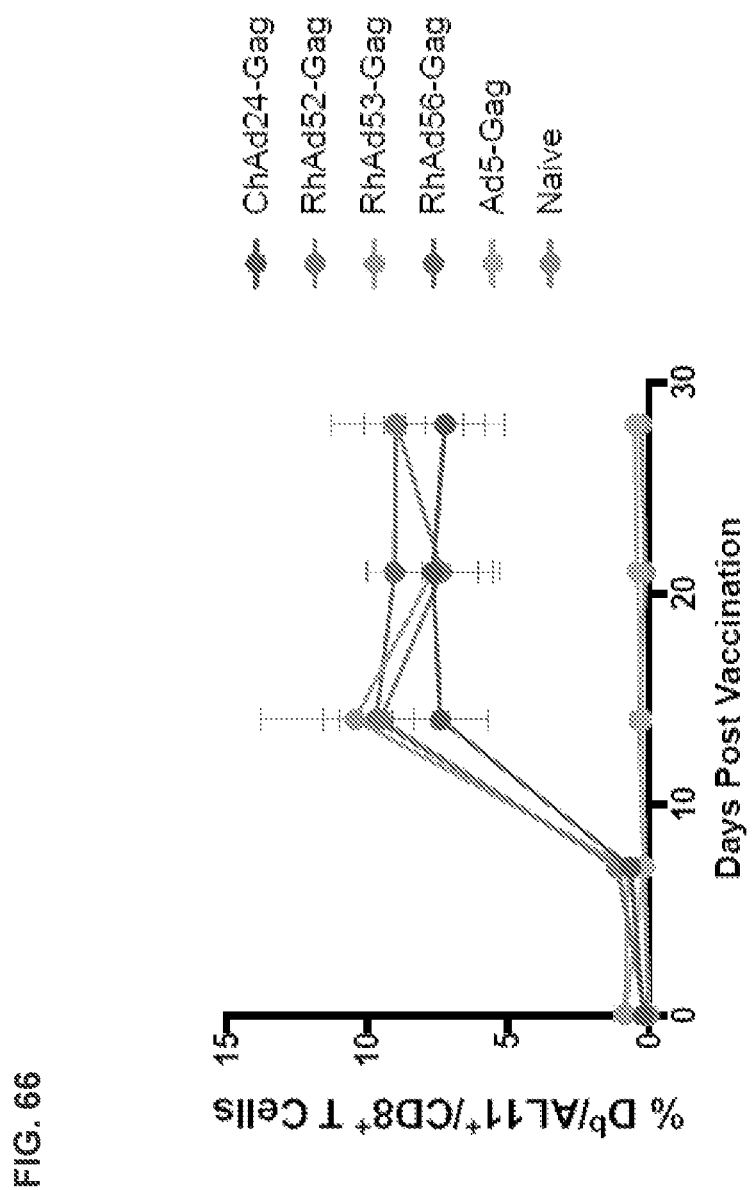
FIG. 66 is a graph showing the longitudinal analysis of $D^b$/AL11$^+$ tetramer binding responses following the priming immunization with the indicated Gag-encoding vector. Error bars indicate standard error of the mean (SEM).
Figure 67:
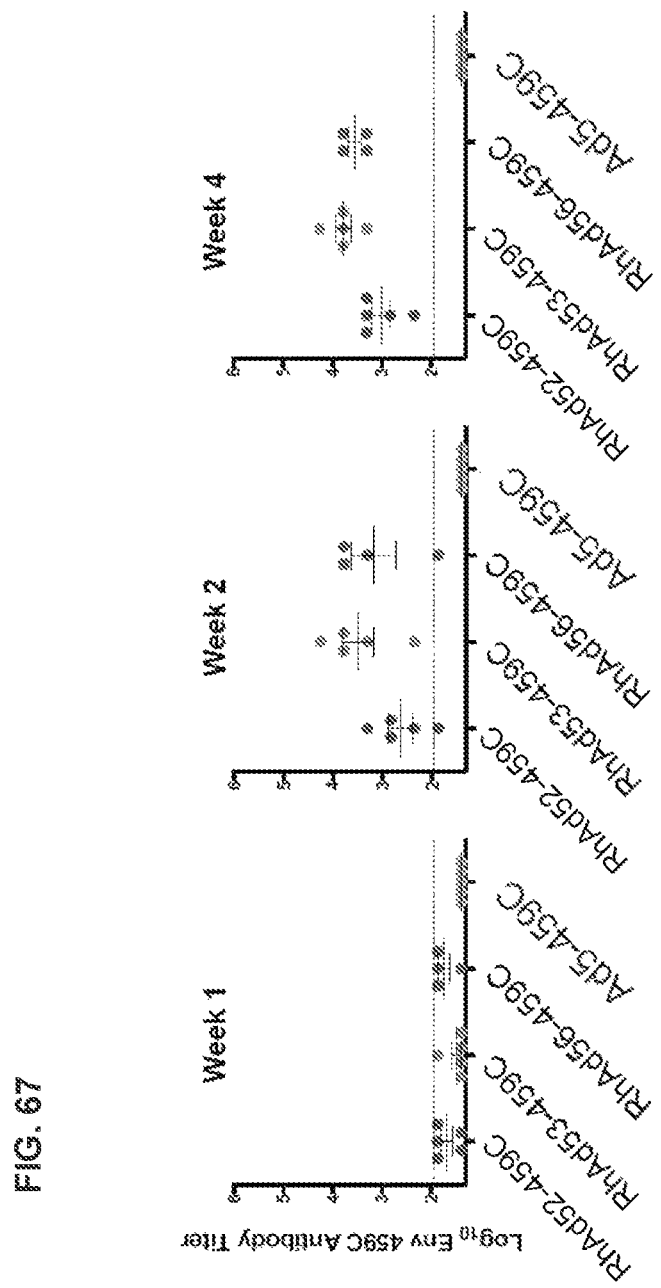
FIG. 67 is a series of graphs showing antibody binding titers for weeks 1, 2, and 4 after priming immunization with the indicated Env-encoding vectors. Error bars indicate standard error of the mean (SEM).
Figure 68:
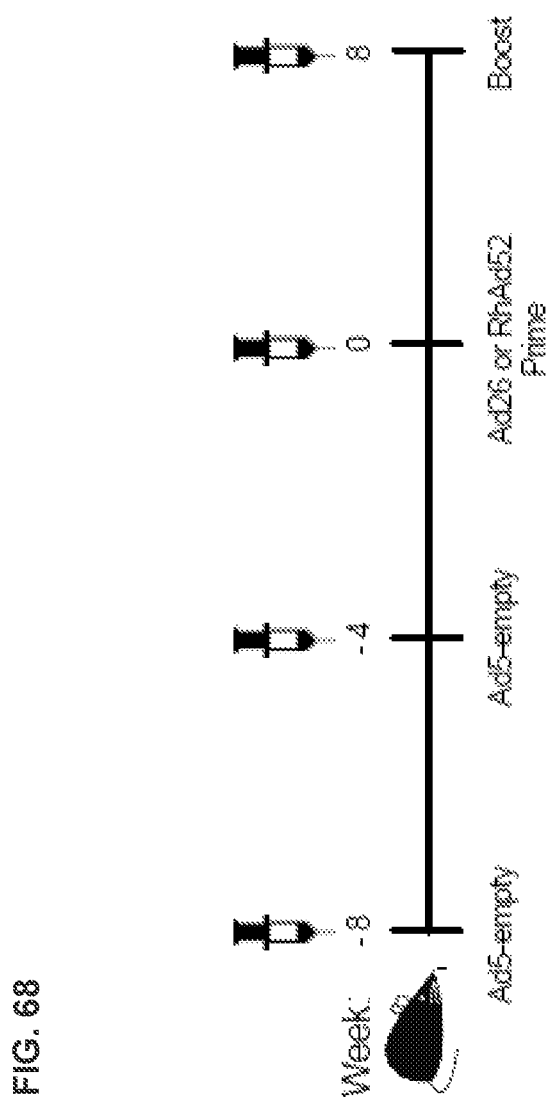
FIG. 68 is a schematic showing the experimental design for a study of RhAd prime-boost regimens in mice (n=4/group) with baseline Ad5-immunity. C57BL/6 mice were primed with an Ad26-Gag or a RhAd52-Gag vector and then boosted 8 weeks later with a boosting vector, as denoted in FIG. 69. Both immunizations were done at $10^9$ vp.

To model the effects of Ad5 pre-existing immunity on RhAd vector immunogenicity, C57BL/6 mice (n=5/group) were injected twice with $10^9$ vp of Ad5-empty at weeks −8 and −4 (FIG. 64). As shown in FIG. 65, these injections raised median $\log_{10}$ Ad5 NAb titers of 3.3 by week 0. At week 0, mice were primed with Ad vectors encoding either SIVGag or 459C-Env gp140, and responses were evaluated by $D^b$/AL11 tetramer binding assays and Env-specific ELISAs. As shown in FIGS. 66 and 67, all RhAds and ChAd24 were unaffected by the presence of high levels of Ad5 pre-existing immunity. In contrast, the immunogenicity of Ad5-Gag and Ad5-Env were ablated by high baseline Ad5 NAb titers, as expected.

Figure 69:
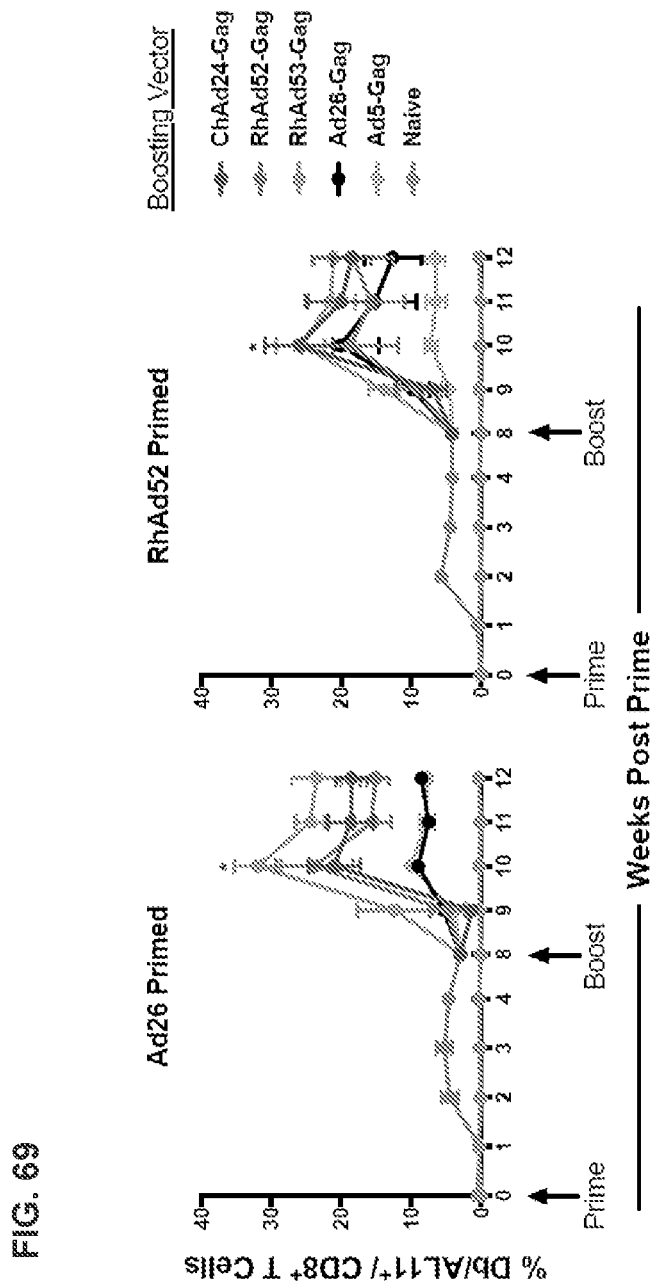
FIG. 69 is two graphs showing the frequency of $D^b$/AL11$^+$ CD8$^+$ T cells in mice tested according to the experimental design shown in FIG. 68. Priming responses were pooled together and displayed as one line (brown) for Ad26-Gag and RhAd52-Gag respectively. Error bars indicate standard error of the mean (SEM).
Figure 70:
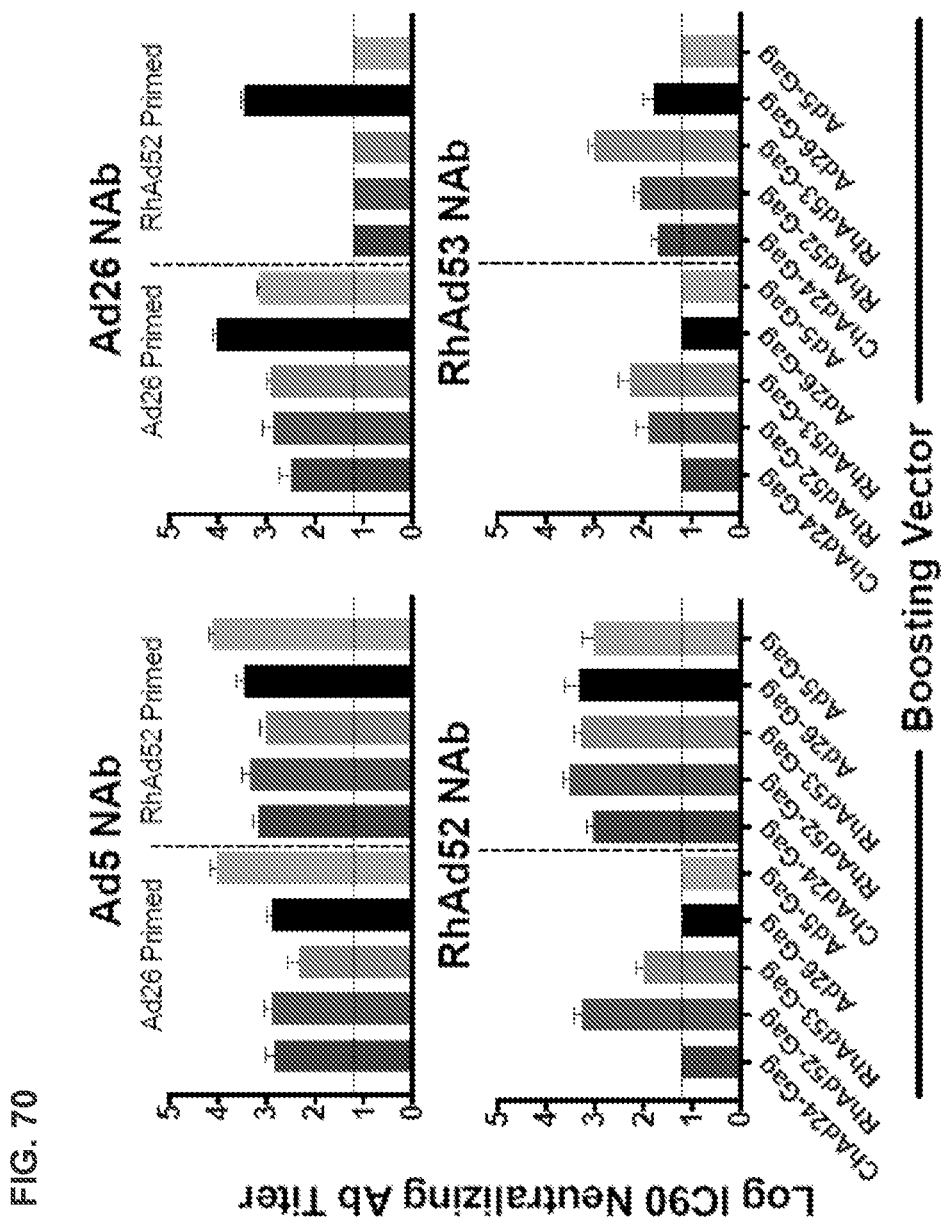
FIG. 70 is a series of graphs showing Ad-specific neutralizing antibody titers 4 weeks after boosting immunization for Ad5, Ad26, RhAd52, and RhAd53 in mice tested according to the experimental design shown in FIG. 68. Dotted horizontal lines indicate limit of detection. Error bars indicate standard error of the mean (SEM).

We next conducted prime-boost immunization experiments in mice with high levels of baseline Ad5 immunity. C57BL/6 mice (n=40) were pre-immunized with two injections of $10^9$ vp Ad5-empty at week −8 and week −4 prior to vaccination (FIG. 65). All mice had high levels of Ad5 NAb titers following the second Ad5-empty injection (median $\log_{10}$ titer 2.7). Four weeks after the second Ad5-empty injection, mice were primed with Ad26-Gag or RhAd52-Gag at week 0 and were boosted with ChAd24-Gag, RhAd52-Gag, RhAd53-Gag, Ad26-Gag, or Ad5-Gag at week 8 (n=4/group). As shown in FIG. 69, Ad5-Gag boosting was poorly immunogenic presumably due to baseline anti-vector immunity, and Ad26-Gag boosting was poorly immunogenic presumably due to anti-vector immunity generated by the priming immunization. In contrast, we observed robust boosting by RhAd53-Gag, RhAd52-Gag, and ChAd24-Gag with $D^b$/AL11 tetramer binding responses, reaching 31.9% of CD8$^+$ T cells at week 10 (RhAd53-Gag vs. Ad5-Gag and Ad26-Gag, P=0.028). In RhAd52-Gag primed mice, all vectors except for Ad5-Gag result in effective boosting responses reaching 26.0% CD8$^+$ T cells at week 10, particularly the heterologous vectors RhAd53-Gag and ChAd24-Gag (RhAd53-Gag and ChAd24-Gag vs. Ad5-Gag, P=0.028). As shown in FIG. 70, Ad26-specific NAbs were only elicited in mice that received Ad26-Gag either as the prime or boost and we observed cross-reactivity among the three RhAds. Moreover, as expected, all mice had high levels of Ad5 NAbs due to the Ad5-Empty pre-immunization. These data demonstrate that high levels of Ad5 pre-existing immunity did not impair Ad26/RhAd or RhAd/RhAd prime-boost regimens.

Figure 71:
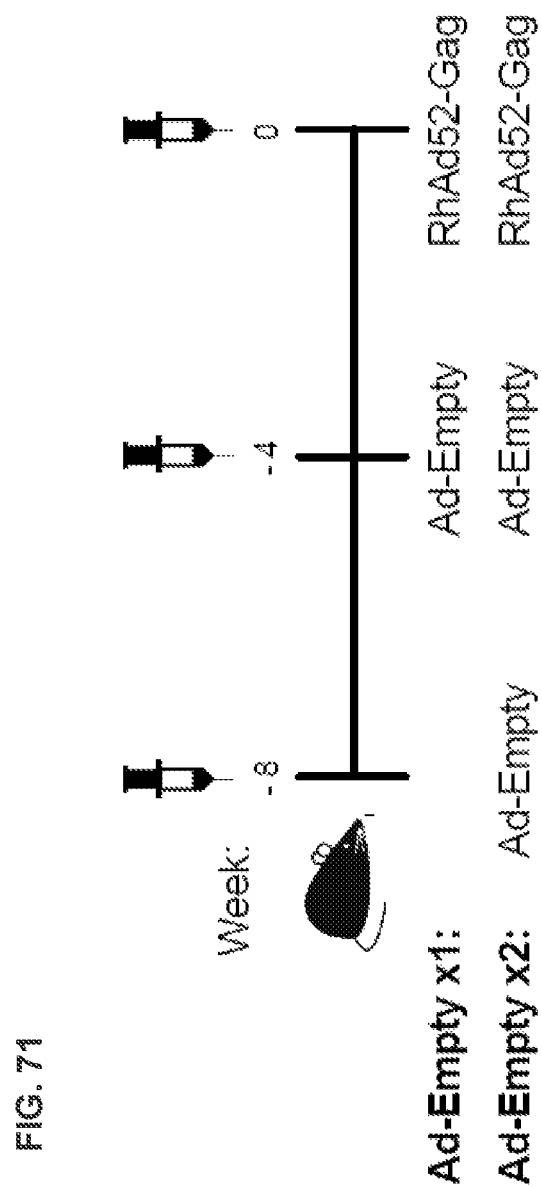
FIG. 71 is a schematic showing the experimental design for a study testing suppression of RhAd52 immunogenicity in a background of baseline RhAd immunity. C57BL/6 mice (n=5/group) were injected with $10^9$ vp of various Ad-empty vectors (Ad26-empty, RhAd52-empty, RhAd53-empty, or RhAd56-empty) either once or twice to induce low or high levels of pre-existing immunity. Mice were then vaccinated with $10^9$ vp of RhAd52-Gag.
Figure 72:
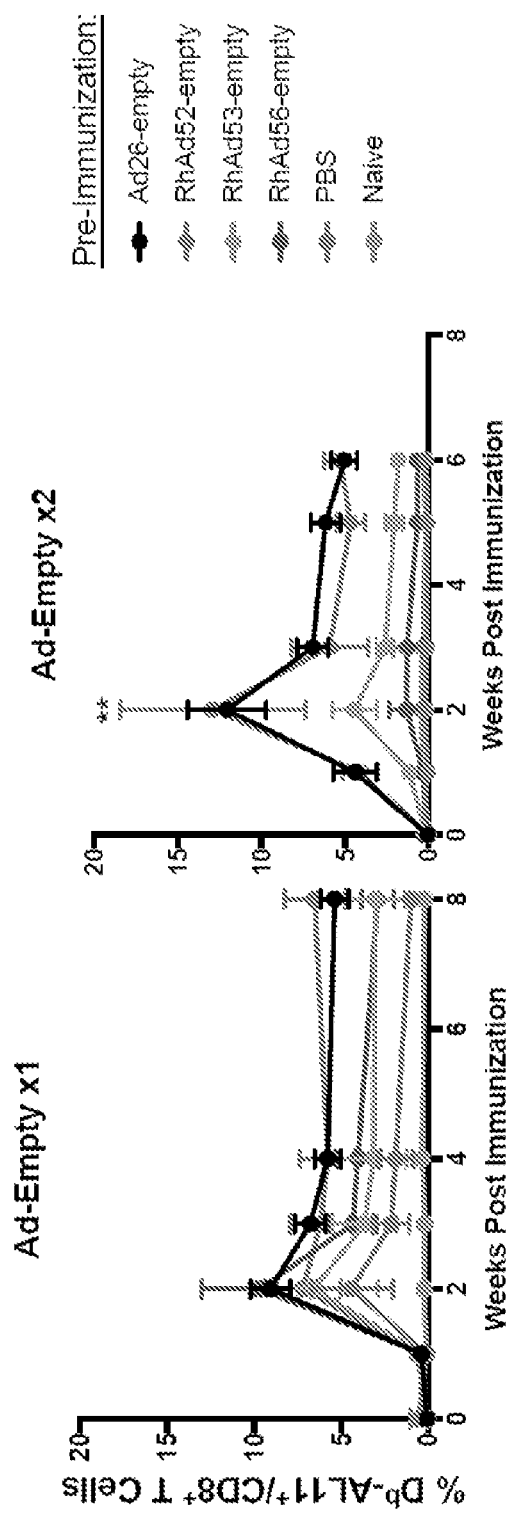
FIG. 72 is two graphs showing the frequency of $D^b$/AL11$^+$ CD8$^+$ T cells following RhAd52-Gag vaccination following one injection of Ad-empty (left) or two injections of Ad-empty (right) in mice tested according to the experimental design shown in FIG. 71. Two injections: PBS versus RhAd52 (**, P=0.0079); PBS versus RhAd56 (*, P=0.015); PBS versus RhAd53 (P=0.055). Error bars indicate standard error of the mean (SEM).
Figure 73:
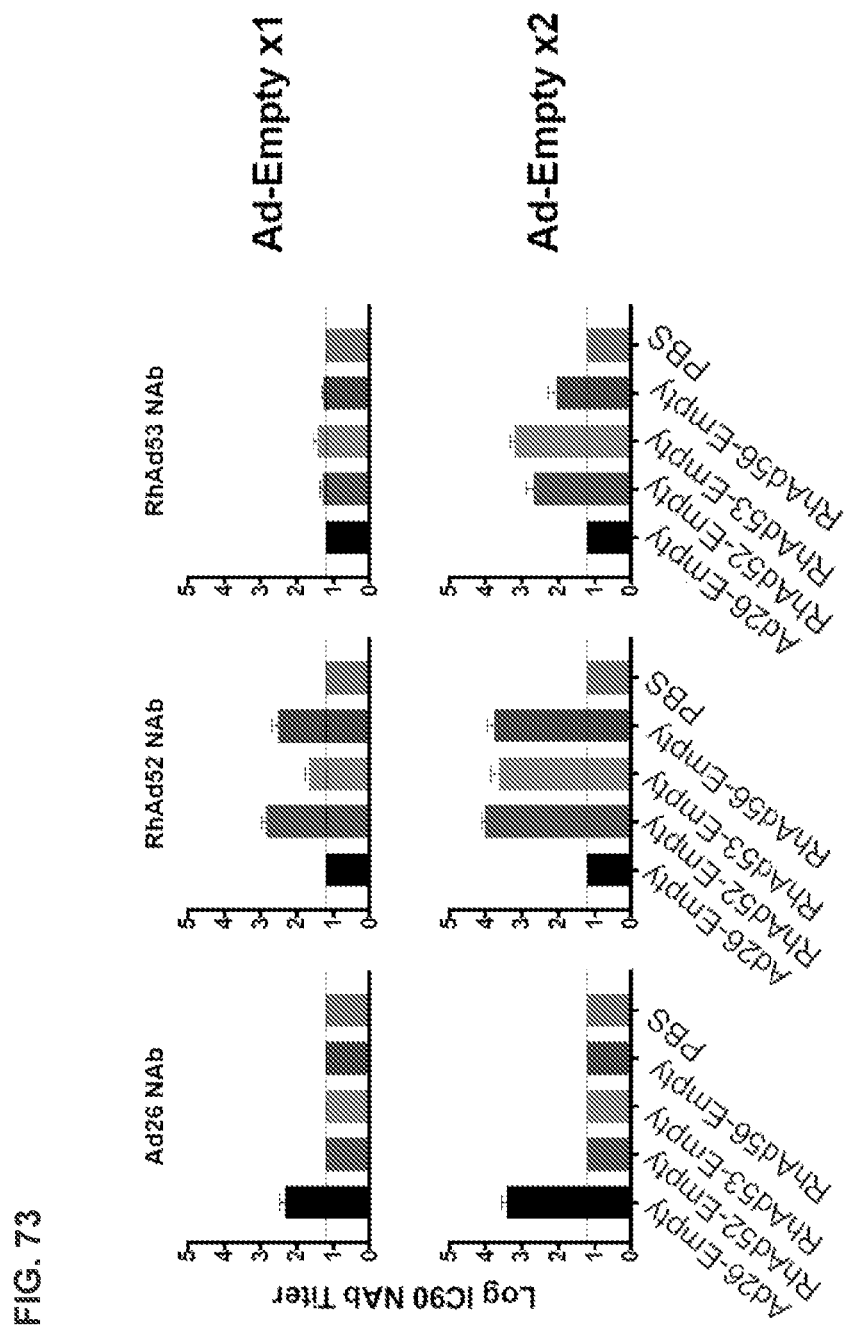
FIG. 73 is a series of graphs showing neutralizing antibody titers four weeks after first (top) or four weeks after second (bottom) empty vector injection, but before RhAd52 vaccination. Dotted horizontal lines indicate limit of detection. Error bars indicate standard error of the mean (SEM).

Impact of cross-reactivity among RhAds on vaccination. We next explored the biological significance of the cross-reactive NAb responses among RhAds in this model. C57BL/6 mice (n=5/group) were pre-immunized with either one or two injections of $10^9$ vp Ad26-empty, RhAd52-empty, RhAd53-empty, RhAd56-empty, or PBS (FIG. 71). Four weeks after the second Ad-Empty pre-immunization, mice received $10^9$ vp of RhAd52-Gag. As seen in FIG. 72, pre-immunization with PBS and Ad26-empty did not blunt the immunogenicity of RhAd52-Gag (PBS vs. RhAd52-Gag, P=0.0079; Ad26-Gag vs. RhAd52-Gag, P=0.0079). However, we observed substantial suppression of the homologous RhAd52-Gag vector with one RhAd52-Empty pre-immunization and complete suppression with two RhAd52-Empty pre-immunizations (FIG. 72), which raised potent baseline RhAd52 NAbs (FIG. 73). We also observed minimal attenuation of RhAd52-Gag responses following one RhAd53-Empty or RhAd56-Empty pre-immunization, but substantial suppression of RhAd52-Gag following two RhAd53-Empty or RhAd56-Empty pre-immunizations, demonstrating that the cross-reactive NAbs among RhAd vectors can be functionally suppressive if induced to particularly high levels (FIGS. 72 and 73). Taken together, these data suggest that cross-reactivity amongst RhAds can suppress a heterologous RhAd vector vaccination if induced to supra-physiologic levels.

Figure 74:
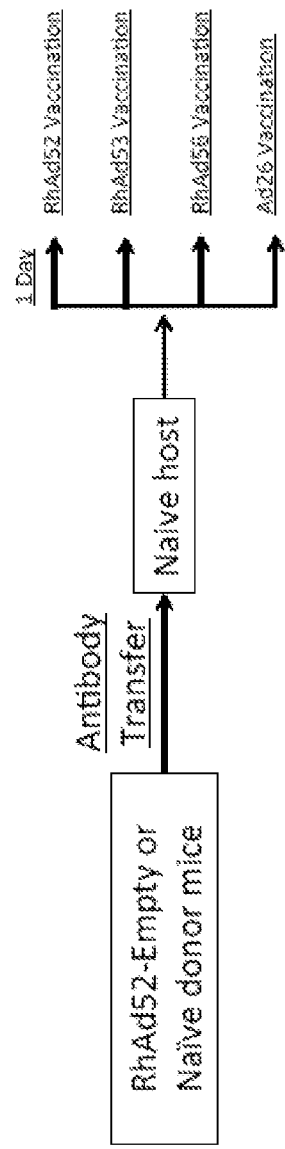
FIG. 74 is a schematic showing the experimental design for a study testing the suppressive potential of cross-reactive RhAd-specific NAbs by adoptive transfer of RhAd52-specific IgG. IgG was purified from pooled serum from mice injected with RhAd52-empty or naïve mice, and 500 µg of IgG was transferred to naïve recipient mice. One day after transfer, recipient mice were vaccinated with $10^9$ vp of RhAd52-Gag, RhAd53-Gag, RhAd56-Gag, or Ad26-Gag (n=5/group).
Figure 75:
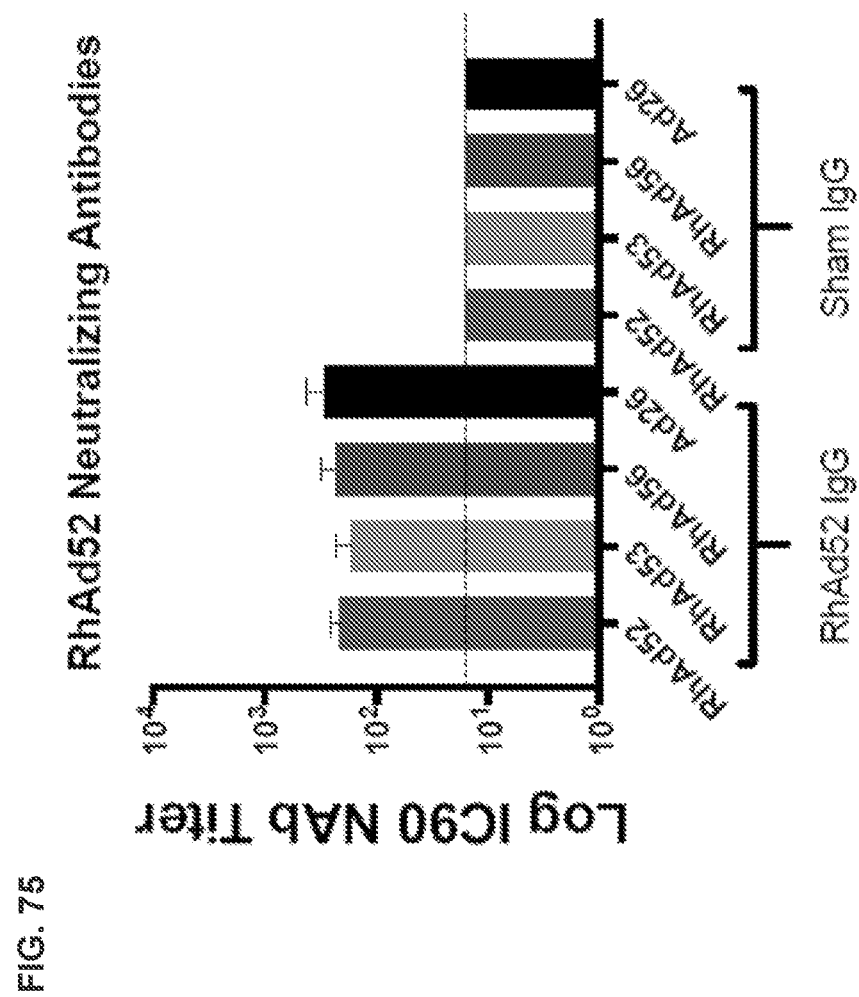
FIG. 75 is a graph showing neutralizing antibody titers one day after adoptive transfer according to the experimental design shown in FIG. 74, but before vaccination with RhAd52-Gag, RhAd53-Gag, RhAd56-Gag, or Ad26-Gag. Error bars indicate standard error of the mean (SEM).
Figure 76:
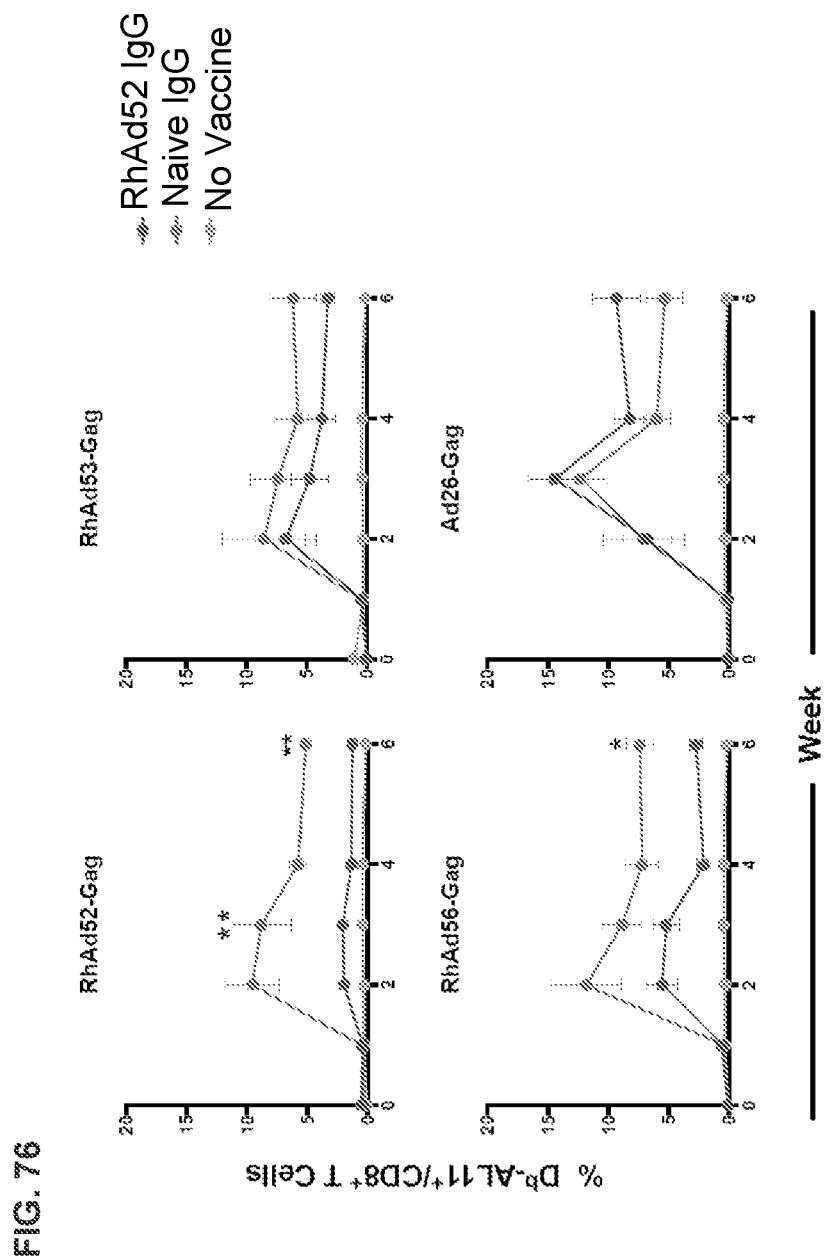
FIG. 76 is a series of graphs showing the frequency of $D^b$/AL11$^+$ CD8$^+$ T cells following adoptive transfer for each vaccine group (*, P<0.05; **, P<0.01). Error bars indicate standard error of the mean (SEM).

Adoptive transfer studies with purified IgG. To explore the suppressive potential of cross-reactive RhAd-specific NAbs in greater detail, we conducted adoptive transfer studies with purified IgG. Donor mice were immunized twice, four weeks apart, with $10^9$ vp of RhAd52-empty (FIG. 74). IgG was then purified from serum, pooled and 500 μg purified IgG was adoptively transferred into naïve recipient mice. As a control, additional groups of recipient mice received IgG purified from unvaccinated control mice. One day after transfer, mice were vaccinated with $10^9$ vp of RhAd52-Gag, RhAd53-Gag, RhAd56-Gag, or Ad26-Gag (n=5/group). Serum collected one-day post IgG transfer prior to Ad-Gag vaccination verified RhAd52 NAbs in mice that received RhAd52 IgG, but not sham IgG (FIG. 75). As shown in FIG. 76, RhAd52 IgG nearly completely suppressed RhAd52-Gag (Week 2: P=0.0079; Week 6: P=0.0079) and partially suppressed RhAd56-Gag (Week 6: P=0.0159), but did not significantly impair RhAd53-Gag or Ad26-Gag, thus confirming the suppressive potential of these cross-reactive NAbs.

Figure 77:
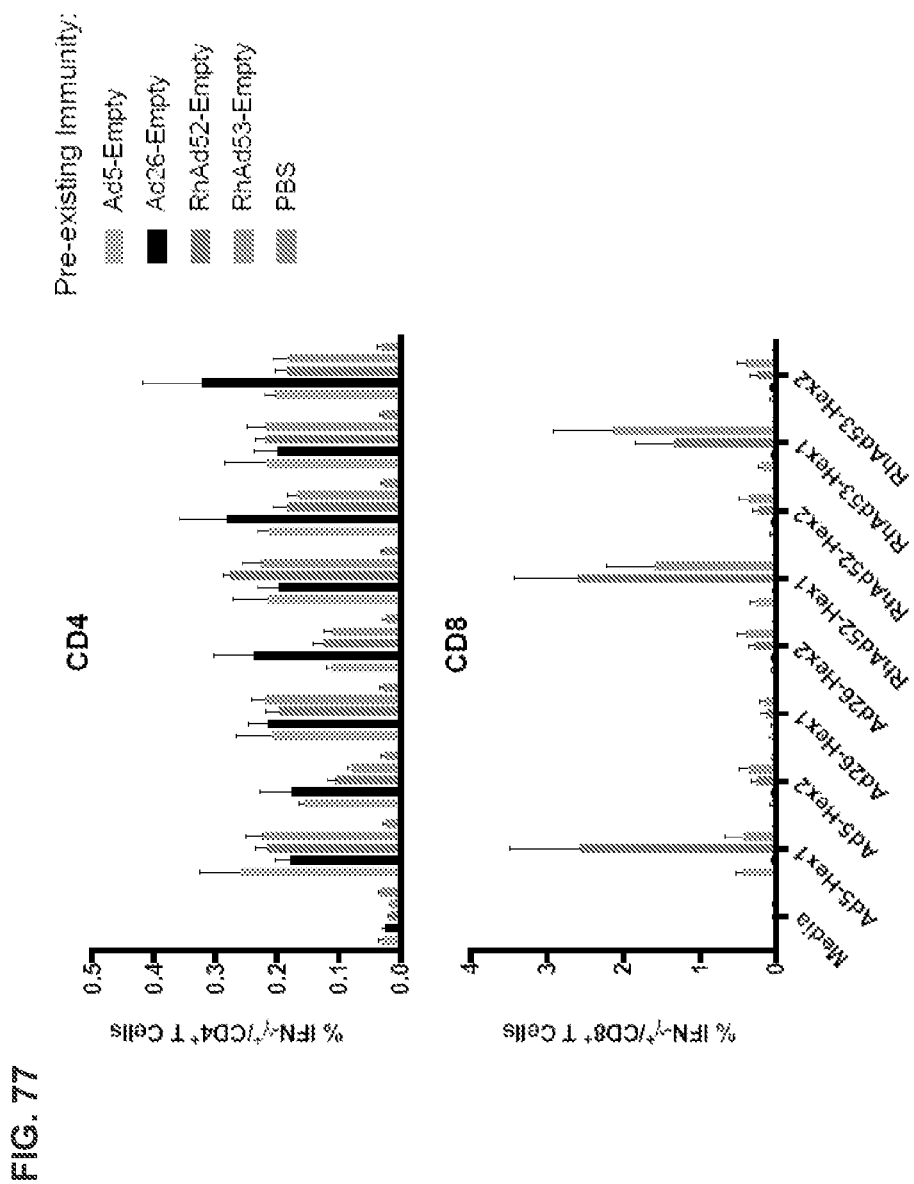
FIG. 77 is two graphs showing the frequency of IFN-γ$^+$ CD4$^+$ and CD8$^+$ T cells responding to peptide pools of 15-mers overlapping by 11 from the hexon regions of Ad5, Ad26, RhAd52, and RhAd53 from mice injected twice with the indicated Ad-empty vector or PBS control. Error bars indicate standard error of the mean (SEM).

Adoptive transfer studies with splenocytes. Cross-reactive cellular responses have previously been reported to be extensive among HuAd serotypes (Frahm et al., *J. Clin. Invest.* 122(1):359-67, 2012). To investigate cellular immune cross-reactivity among RhAd vectors, groups of naïve C57BL/6 mice (n=5/group) were injected twice with $10^9$ vp of Ad5-empty, Ad26-empty, RhAd52-empty, or RhAd53-empty four weeks apart. Four weeks after the final injection, spleens were harvested and stimulated with overlapping 15-mer hexon peptides spanning the entire hexon region of each serotype. As shown in FIG. 77, CD4$^+$ T cells exhibited extensive cross-reactivity to homologous and heterologous peptide pools. In contrast, CD8$^+$ T cells were more restricted in their cross-reactivity. These data suggest broad cross-reactivity for CD4 responses and less extensive cross-reactivity for CD8 responses induced by RhAd vectors.

Figure 78:
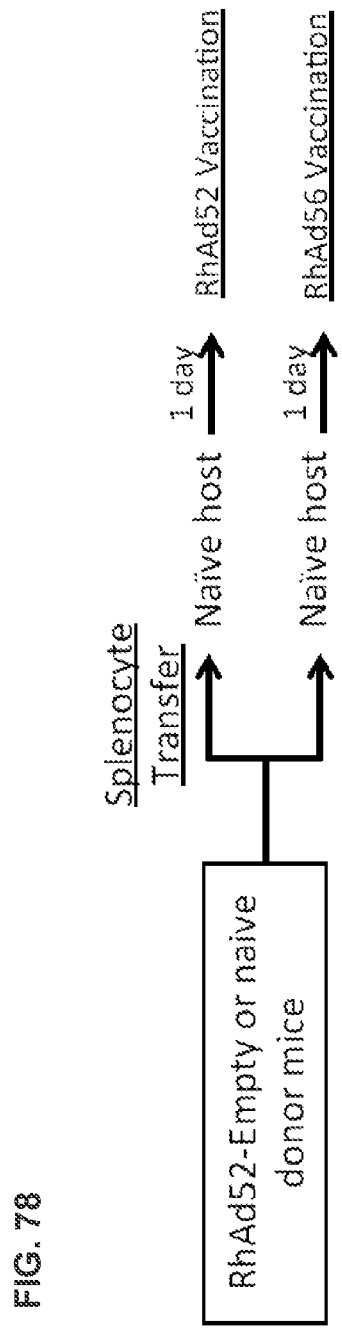
FIG. 78 is a schematic showing the experimental design to test cellular immune cross-reactivity among RhAd vectors using rhAd52-specific splenocytes. Splenocytes were pooled from mice that were injected twice with RhAd52-empty or from naïve mice. Donor splenocytes were transferred into naïve host and one day later they were vaccinated with either RhAd52-Gag or RhAd56-Gag (n=5/group).
Figure 79:
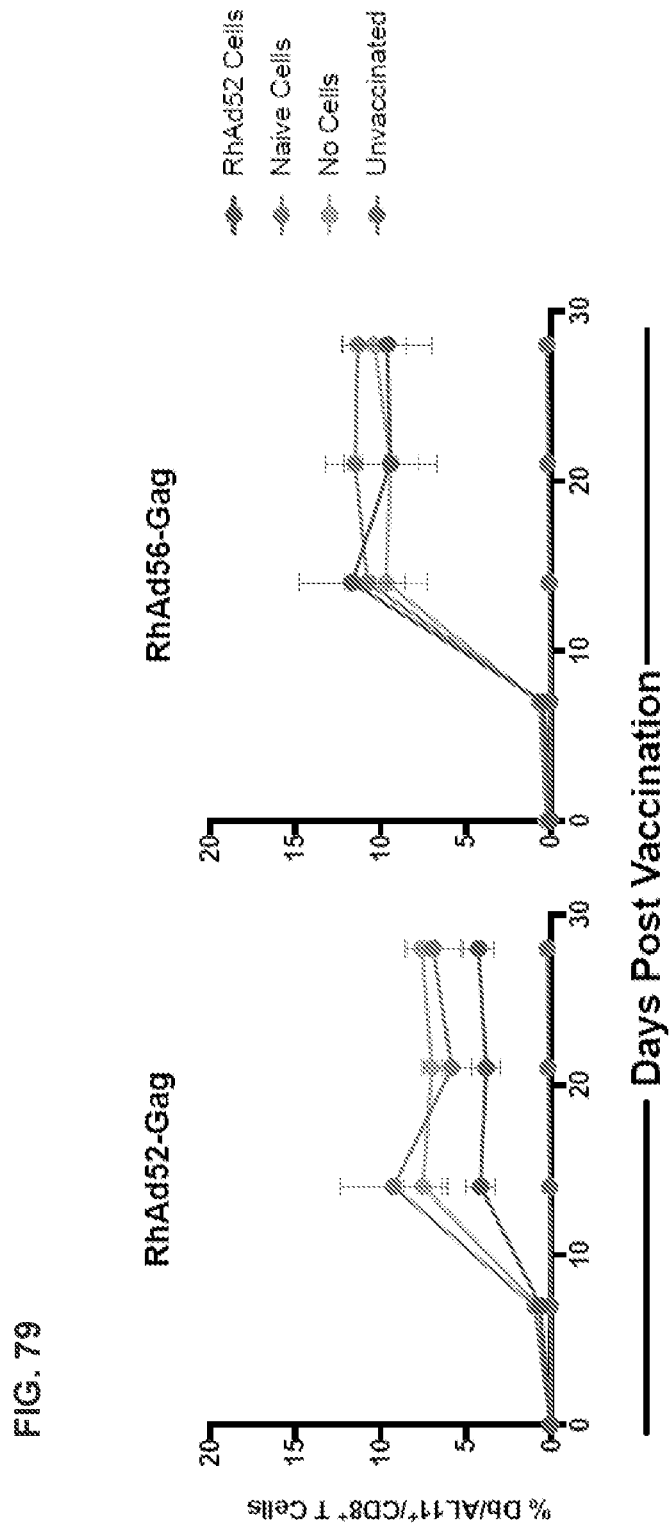
FIG. 79 is a series of graphs showing the frequency of $D^b$/AL11$^+$ CD8$^+$ T cells following cell transfer and vaccination according to the experimental design of FIG. 78. Error bars indicate standard error of the mean (SEM).

Finally, we performed a cellular adoptive transfer study to evaluate the biological significance of these cross-reactive T cell responses in this model. C57BL/6 mice were injected twice with $10^9$ vp RhAd52-empty or saline four weeks apart raising median NAb $\log_{10}$ titers of 2.3 among the RhAd52-Empty groups (FIG. 78). Groups of naïve recipient mice (n=5/group) received $5 \times 10^7$ pooled splenocytes from RhAd52-immune or naïve-donor mice and then were vaccinated with either RhAd52-Gag or RhAd56-Gag. As shown in FIG. 79, mice that received splenocytes from mice injected with RhAd52-Gag demonstrated a trend towards partial attenuation of the homologous RhAd52-Gag vaccine, but not to the heterologous RhAd56-Gag vaccine. These data suggest a modest effect of RhAd-specific cellular immune responses, but less striking than RhAd-specific NAb responses.

IgG purification. IgG was purified from mouse serum using the IgG purification NAb Spin Kits (ThermoScientific) according to manufacturer's instructions. Serum was bound to the spin column and washed with binding buffer (ThermoScientific). Bound IgG was then eluted using elution buffer (0.1 M Glycine, pH 2-3) and neutralized with neutralization buffer (1 M Tris, pH 8.5-9). IgG was then buffer exchanged into 1×PBS via spin columns (Amicon Ultra 10k Device).

Adoptive transfers. Adoptive transfer studies were performed essentially as previously described (Sumida et al., *J. Virol.* 78:2666-2673, 2004). Donor mice were immunized twice, 4 weeks apart, with RhAd52-Empty to generate baseline vector immunity. Recipient mice received either $5 \times 10^7$ splenocytes or purified IgG from either the RhAd52 donor mice or naïve donor mice via the intravenous route. One day following adoptive transfer, mice were vaccinated with RhAd52, RhAd53, RhAd56, or Ad26 vectors expressing SIV Gag. Following vaccination, mice were followed weekly for tetramer binding responses as mentioned above.

Statistical analysis. Statistical analyses were performed using two-tailed nonparametric Mann-Whitney UT-test using GraphPad Prism version 7.0 (GraphPad Software).

Discussion

In this study, we evaluated the immunogenicity and cross-reactivity of a panel of RhAd vectors, which all cluster phylogenetically into the poorly studied species G of Adenoviridae. We demonstrate that these RhAd vectors were highly immunogenic in the presence of high levels of pre-existing HuAd-specific immunity, and could be combined into potent HuAd/RhAd and RhAd/RhAd prime-boost vaccine regimens. Moreover, we defined a degree of cross-reactive NAbs among the RhAds as well as extensive cellular cross-reactivity between HuAds and RhAds. Nevertheless, RhAd-RhAd prime-boost regimens remained highly immunogenic, although suppression by supraphysiologic titers of cross-reactive NAbs could impair immunogenicity. These data demonstrate the immunogenicity of RhAd vectors and their utility as candidate vaccine vectors, e.g., in humans.

Our data show that the RhAds induced a cellular immune phenotype more similar to Ad26 than Ad5 and were highly immunogenic despite high levels of HuAd pre-existing immunity (FIGS. 55-61 and 68-70). To our knowledge, this is the most in-depth assessment of vaccine-elicited immune responses by species G-based adenoviral vectors.

Pre-existing immunity to adenoviral vectors, particularly baseline NAbs, has been shown to suppress the immunogenicity of Ad vectors (Abbink et al., *J. Virol.* 81(9):4654-63, 2007; Shiver and Emini, *Annu. Rev. Med.* 55:355-72, 2004; Dudareva et al., *Vaccine* 27(27):3501-4, 2009; Lemckert et al., *J. Virol.* 79(15):9694-701, 2005). These NAbs are typically serotype-specific, although we previously identified cross-reactive NAbs between human Ad11 and Ad35 (Lemckert et al., *J. Virol.* 79(15):9694-701, 2005). Here we observed a degree of cross-reactive NAbs between RhAd52, RhAd53, and RhAd56, although the cross-reactive NAbs were lower than homologous NAbs and did not impair the immunogenicity of RhAd-RhAd prime-boost regimens (FIGS. 59-61 and 68-70) unless induced to very high titers FIG. 71-73. The extent of cross-reactivity among the RhAds reflected their phylogenetic relatedness FIGS. 55A and 55B. For example, RhAd52 and RhAd56 are more closely related in terms of their full genomes and more readily induce cross-reactive NAbs to each other than RhAd53. RhAd seroprevalence is exceedingly low in the human population and NAb titers when present are very low (Roy et al., *PLoS Pathog* 5:e1000503, 2009).

Cellular immune responses to adenoviruses are extensively cross-reactive across serotypes (Frahm et al., *J. Clin. Invest.* 122(1):359-67, 2012; Barouch et al., *J. Infect. Dis.* 207(2):248-56, 2013; Heemskerk et al., *J. Virol.* 77(11): 6562-6, 2003) and may have a secondary role in suppressing vaccine-elicited immune responses (Fausther-Bovendo and Kobinger, *Hum. Vaccin. Immunother.* 10(10):2875-84, 2014; Frahm et al., *J. Clin. Invest.* 122(1):359-67, 2012; Lemckert et al., *J. Virol.* 79(15):9694-701, 2005). We show here that RhAds conform to this paradigm as well, with broad CD4 T cell cellular cross-reactivity and more limited CD8 T cell cross-reactivity. However, cross-reactive NAbs are likely more relevant to attenuating vector immunogenicity than are cross-reactive cellular responses (FIGS. 74-76 and 77-79).

In conclusion, our data demonstrate the potent immunogenicity of RhAd vectors in mice. We observed a degree of humoral cross-reactivity and extensive cellular cross-reactivity among RhAd vectors. Nevertheless, HuAd/RhAd and RhAd/RhAd prime-boost regimens were highly immunogenic, and all the RhAds effectively circumvented high levels of baseline Ad5-specific immunity. These data suggest that RhAd vectors can be used as candidate vaccines in prime-boost regimens, for example, in humans.

OTHER EMBODIMENTS

While the invention has been described in connection with specific embodiments thereof, it will be understood that it is capable of further modifications and this application is intended to cover any variations, uses, or adaptations of the invention following, in general, the principles of the invention and including such departures from the present disclosure that come within known or customary practice within the art to which the invention pertains and may be applied to the essential features hereinbefore set forth.

All publications and patent applications mentioned in this specification are herein incorporated by reference to the same extent as if each independent publication or patent application was specifically and individually indicated as being incorporated by reference in their entirety.

APPENDIX: TUMOR-ASSOCIATED ANTIGENS

TABLE A

| | | Ovarian cancer | |
|---|---|---|---|
| No. | Tumor-associated antigen | Reported immunogenic epitopes | Sources |
| 1 | Kallikrein 4 | FLGYLILGV; SVSESDTIRSISIAS; LLANGRMPTVLQCVN; and RMPTVLQCVNVSVVS | Wilkinson et al. Cancer Immunol. Immunother. 61(2): 169-79 (2012). Hural et al. J. Immunol. 169(1): 557-65 (2002). |
| 2 | PBF | CTACRWKKACQR | Tsukahara et al. Cancer Res. 64(15): 5442-8 (2004). |
| 3 | PRAME | VLDGLDVLL; SLYSFPEPEA; ALYVDSLFFL; SLLQHLIGL; and LYVDSLFFL | Kessler et al. J. Exp. Med. 193(1): 73-88 (2001). Ikeda et al. Immunity 6(2): 199-208 (1997). |

TABLE A-continued

Ovarian cancer

| No. | Tumor-associated antigen | Reported immunogenic epitopes | Sources |
|---|---|---|---|
| 4 | WT1 | TSEKRPFMCAY; CMTWNQMNL; LSHLQMHSRKH; KRYFKLSHLQMHSRKH; and KRYFKLSHLQMHSRKH | Asemissen et al. Clin. Cancer Res. 12(24): 7476-82 (2006) Ohminami et al. Blood. 95(1): 286-93 (2000). Guo et al. Blood. 106(4): 1415-8 (2005). Lin et al. J. Immunother. 36(3): 159-70 (2013). Fujiki et al. J. Immunother. 30(3): 282-93 (2007). |
| 5 | HSDL1 | CYMEAVAL | Wick et al. Clin. Cancer Res. 20(5): 1125-34 (2014). |
| 6 | Mesothelin | SLLFLLFSL VLPLTVAEV ALQGGGPPY LYPKARLAF AFLPWHRLF | Hassan et al. Appl. Immunohistochem. Mol. Morphol. 13(3): 243-7 (2005). Thomas et al J Exp Med. 2004 Aug. 2; 200(3): 297-306. |
| 7 | NY-ESO-1 | HLA-A2-restricted peptide p157-165 (SLLMWITQC), HLA-Cw3-restricted (LAMP- FATPM) and HLA-Cw6-restricted (ARGPESRLL) SLLMWITQC MLMAQEALAFL YLAMPFATPME ASGPGGGAPR LAAQERRVPR TVSGNILTIR APRGPHGGAASGL MPFATPMEAEL KEFTVSGNILTI MPFATPMEA FATPMEAEL FATPMEAELAR LAMPFATPM ARGPESRLL SLLMWITQCFLPVF LLEFYLAMPFATPMEAEL-ARRSLAQ EFYLAMPFATPM PGVLLKEFTVSGNILTIRL-TAADHR RLLEFYLAMPFA QGAMLAAQERRVPRAAE-VPR PFATPMEAELARR PGVLLKEFTVSGNILTIRLT VLLKEFTVSG AADHRQLQLSISSCLQQL LKEFTVSGNILTIRL PGVLLKEFTVSGNILTIRL-TAADHR LLEFYLAMPFATPMEAEL-ARRSLAQ KEFTVSGNILT LLEFYLAMPFATPM AGATGGRGPRGAGA | Jager et al. Proc. Natl. Acad. Scie. U.S.A. 103(39): 14453-8 (2006). p92-100 Gnjatic et al. PNAS Sep. 26, 2000 vol. 97 no. 20 p. p80-88 1091 9 Jager et al. J Exp Med. 187(2): 265-70 (1998). Chen et al. J Immunol. 165(2): 948-55 (2000). Valmori et al. Cancer Res. 60(16): 4499-506 (2000). Aarnoudse et al. Int J Cancer. 82(3): 442-8 (1999). Eikawa et al. Int J Cancer. 132(2): 345-54 (2013). Wang et al. J Immunol. 161(7): 3598-606 (1998). Matsuzaki et al. Cancer Immunol Immunother. 57(8)1185-95 (2008). Ebert et al. Cancer Res. 69(3)1 046-54 (2009). Eikawa et al. Int J Cancer. 132(2): 345-54 (2013). Knights et al. Cancer Immunol Immunother. 58(3): 325-38 (2009). Jäger et al. Cancer Immun. 2: 12 (2002). Zeng et al. Proc Natl Acad Sci USA. 98(7): 3964-9 (2001). Mandic et al. J Immunol. 174(3): 1751-9 (2005). Chen et al. Proc Natl Acad Sci USA. 101(25): 9363-8 (2004). Ayyoub et al. Clin Cancer Res. 16(18): 4607-15 (2010). Slager et al. J Immunol. 172(8): 5095-102 (2004). Mizote et al. Vaccine. 28(32): 5338-46 (2010). Jager et al. J Exp Med. 191(4): 625-30 (2000). Zarour et al. Cancer Res. 60(17): 4946-52 (2000). Zeng et al. J Immunol. 165(2): 1153-9 (2000). Bioley et al. Clin Cancer Res. 15(13): 4467-74 (2009). Zarour et al. Cancer Res. 62(1): 213-8 (2002). Hasegawa et al. Clin Cancer Res. 12(6): 1921-7 (2006). |
| 8 | CEA | TYYRPGVNLSLSC EIIYPNASLLIQN YACFVSNLATGRNNS LWWVNNQSLPVSP | Galanis et al. Cancer Res. 70(3): 875-82 (2010). Bast et al. Am. J. Obstet. Gynecol. 149(5): 553-9 (1984). |

TABLE A-continued

Ovarian cancer

| No. | Tumor-associated antigen | Reported immunogenic epitopes | Sources |
|---|---|---|---|
| | | LWWVNNQSLPVSP<br>LWWVNNQSLPVSP<br>EIIYPNASLLIQN<br>NSIVKSITVSASG<br>KTWGQYVVQV<br>(A)MLGTHTMEV<br>ITDQVPFSV<br>YLEPGPVTA<br>LLDGTATLRL<br>VLYRYGSFSV<br>SLADTNSLAV<br>RLMKQDFSV<br>RLPRIFCSC<br>LIYRRLMK<br>ALLAVGATK<br>IALNFPGSQK<br>RSYVPLAHR | Crosti et al. J Immunol. 176(8): 5093-9 (2006).<br>Kobayashi et al. Clin Cancer Res. 8(10): 3219-25 (2002).<br>Campi et al. Cancer Res. 63(23): 8481-6 (2003).<br>Bakker et al. Int J Cancer. 62(1): 97-102 (1995).<br>Tsai et al. J Immunol. 158(4): 1796-802 (1997).<br>Kawakami et al. J Immunol. 154(8): 3961-8 (1995).<br>Cox et al. Science. 264(5159): 716-9 (1994).<br>Kawakami et al. J Immunol. 154(8): 3961-8 (1995).<br>Kawakami et al. J Immunol. 161(12): 6985-92 (1998).<br>Skipper et al. J Immunol. 157(11): 5027-33 (1996).<br>Michaux et al. J Immunol. 192(4): 1962-71(2014). |
| 9 | p53 | VVPCEPPEV | Hung et al. Immunol. Rev. 222: 43-69 (2008). |
| 10 | Her2/Neu | HLYQGCQVV<br>YLVPQQGFFC<br>PLQPEQLQV<br>TLEEITGYL<br>ALIHHNTHL<br>PLTSIISAV<br>VLRENTSPK<br>TYLPTNASL | Nakatsuka et al. Mod. Pathol. 19(6): 804-814 (2006).<br>Pils et al. Br. J. Cancer 96(3): 485-91 (2007).<br>Scardino et al. Eur J Immunol. 31(11): 3261-70 (2001).<br>Scardino et al. J Immunol. 168(11): 5900-6 (2002).<br>Kawashima et al. Cancer Res. 59(2): 431-5 (1999).<br>Okugawa et al. Eur J Immunol. 30(11): 3338-46 (2000). |
| 11 | EpCAM | RYQLDPKFI | Spizzo et al. Gynecol. Oncol. 103(2): 483-8 (2006).<br>Tajima et al. Tissue Antigens. 64(6): 650-9 (2004). |
| 12 | CA125 | ILFTINFTI<br>VLFTINFTI<br>TLNFTITNL<br>VLQGLLKPL<br>VLQGLLRPV<br>RLDPKSPGV<br>QLYWELSKL<br>KLTRGIVEL<br>QLTNGITEL<br>QLTHNITEL<br>TLDRNSLYV | Bast et al. Cancer 116(12): 2850-2853 (2010). |
| 13 | Folate receptor α | FLLSLALML<br>NLGPWIQQV | Bagnoli et al. Gynecol. Oncol. 88: S140-4 (2003).<br>Pampeno et al. (2016) High-ranking In Silico epitopes [determined by 3 algorithms: BISMAS, IEDB, RANKPEP] unpublished |
| 14 | Sperm protein 17 | ILDSSEEDK | Chiriva-Inernati et al. J. Immunother. 31(8): 693-703 (2008). |
| 15 | TADG-12 | YLPKSWTIQV<br>WIHEQMERDLKT | Bellone et al. Cancer 115(4): 800-11 (2009).<br>Underwood et al. BBA Mol. Basis of Disease. 1502(3): 337-350 (2000). |
| 16 | MUC-16 | ILFTINFTI<br>VLFTINFTI<br>TLNFTITNL<br>VLQGLLKPL | Chekmasova et al. Clin. Cancer Res. 16(14): 3594-606 (2010). |

TABLE A-continued

Ovarian cancer

| No. | Tumor-associated antigen | Reported immunogenic epitopes | Sources |
|---|---|---|---|
| | | VLQGLLRPV<br>RLDPKSPGV<br>QLYWELSKL<br>KLTRGIVEL<br>QLTNGITEL<br>QLTHNITEL<br>TLDRNSLYV | |
| 17 | L1CAM | LLANAYIYV<br>YLLCKAFGA<br>KLSPYVHYT | Hong et al. J. Immunother. 37(2): 93-104 (2014).<br>Pampeno et al. (2016) High-ranking In Silico epitopes [determined by 3 algorithms: BISMAS, IEDB, RANKPEP} unpublished |
| 18 | Mannan-MUC-1 | PDTRPAPGSTAPPAHGVTSA<br>STAPPVHNV<br>LLLLTVLTV<br>PGSTAPPAHGVT | Loveland et al. Clin. Cancer Res. 12(3 Pt 1): 869-77 (2006).<br>Godelaine et al. Cancer Immunol Immunother. 56(6): 753-9 (2007).<br>Ma et al. Int J Cancer. 129(10): 2427-34 (2011).<br>Wen et al. Cancer Sci. 102(8): 1455-61 (2011).<br>Jerome et al. J Immunol. 151(3): 1654-62 (1993).<br>Brossart et al. Blood. 93(12): 4309-17 (1999).<br>Hiltbold et al. Cancer Res. 58(22): 5066-70 (1998). |
| 19 | HERV-K-MEL | MLAVISCAV | Schiavetti et al. Cancer Res. 62(19): 5510-6 (2002). |
| 20 | KK-LC-1 | RQKRILVNL | Fukuyama et al. Cancer Res. 66(9): 4922-8 (2006). |
| 21 | KM-HN-1 | NYNNFYRFL<br>EYSKECLKEF<br>EYLSLSDKI | Fukuyama et al. Cancer Res. 66(9): 4922-8 (2006).<br>Monji et al. Clin Cancer Res. 10(19 Pt 1): 6047-57 (2004). |
| 22 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVP-R<br>AADHRQLQLSISSCLQQL<br>CLSRRPWKRSWSAGSCPG-MPHL<br>ILSRDAAPLPRPG<br>AGATGGRGPRGAGA | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 23 | MAGE-A4 | EVDPASNTY<br>GVYDGREHTV<br>NYKRCFPVI<br>SESLKMIF | Kobayashi et al. Tissue Antigens. 62(5): 426-32 (2003).<br>Duffour et al. Eur J Immunol. 29(10): 3329-37 (1999).<br>Miyahara et al. Clin Cancer Res. 11(15): 5581-9 (2005).<br>Ottaviani et al. Cancer Immunol Immunother. 55(7): 867-72 (2006)<br>Zhang et al. Tissue Antigens. 60(5): 365-71 (2002). |

TABLE A-continued

Ovarian cancer

| No. | Tumor-associated antigen | Reported immunogenic epitopes | Sources |
|---|---|---|---|
| 24 | Sp17 | ILDSSEEDK | Chiriva-Internati et al. Int J Cancer. 107(5): 863-5 (2003). |
| 25 | SSX-4 | INKTSGPKRGKHAWTHRLRE<br>YFSKKEWEKMKSSEKIVYVY<br>MKLNYEVMTKLGFKVTLPPF<br>KHAWTHRLRERKQLVVYEEI<br>LGFKVTLPPFMRSKRAADFH<br>KSSEKIVYVYMKLNYEVMTK<br>KHAWTHRLRERKQLVVYEEI | Ayyoub et al. Clin Immunol. 114(1): 70-8 (2005).<br>Valmori et al. Clin Cancer Res. 12(2): 398-404 (2006). |
| 26 | TAG-1 | SLGWLFLLL<br>LSRLSNRLL | Adair et al. J Immunother. 31(1): 7-17 (2008). |
| 27 | TAG-2 | LSRLSNRLL | Adair et al. J Immunother. 31(1): 7-17 (2008). |

TABLE B

Breast cancer

| No. | Tumor-associated antigen | Reported immunogenic epitopes | Sources |
|---|---|---|---|
| 1 | ENAH (hMena) | TMNGSKSPV | Di Modugno et al. Int. J. Cancer. 109(6): 909-18 (2004). |
| 2 | mammaglobin-A | PLLENVISK | Jaramillo et al. Int. J. Cancer. 102(5): 499-506 (2002). |
| 3 | NY-BR-1 | SLSKILDTV | Wang et al. Cancer Res. 66(13): 6826-33 (2006). |
| 4 | EpCAM | RYQLDPKFI | Gastl et al. Lancet 356(9246): 1981-2 (2000).<br>Tajima, 2004 |
| 5 | NY-ESO-1 | HLA-A2-restricted peptide p157-165 (SLLMWITQC), HLA-Cw3-restricted p92-100 (LAMP- FATPM) and HLA-Cw6-restricted p80-88 (ARGPESRLL)<br>SLLMWITQC<br>MLMAQEALAFL<br>YLAMPFATPME<br>ASGPGGGAPR<br>LAAQERRVPR<br>TVSGNILTIR<br>APRGPHGGAASGL<br>MPFATPMEAEL<br>KEFTVSGNILTI<br>MPFATPMEA<br>FATPMEAEL<br>FATPMEAELAR<br>LAMPFATPM<br>ARGPESRLL<br>SLLMWITQCFLPVF<br>LLEFYLAMPFATPMEAEL-ARRSLAQ<br>EFYLAMPFATPM<br>PGVLLKEFTVSGNILTIRL-TAADHR<br>RLLEFYLAMPFA<br>QGAMLAAQERRVPRAAE-VPR<br>PPATPMEAELARR<br>PGVLLKEFTVSGNILTIRLT<br>VLLKEFTVSG<br>AADHRQLQLSISSCLQQL | Jager et al. Proc. Natl. Acad. Scie. U.S.A. 103(39): 14453-8 (2006).<br>Gnjatic et al. PNAS September 26, 2000 vol. 97 no. 20 p. 1091 9<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010). |

TABLE B-continued

Breast cancer

| No. | Tumor-associated antigen | Reported immunogenic epitopes | Sources |
|---|---|---|---|
|  |  | LKEFTVSGNILTIRL<br>PGVLLKEFTVSGNILTIRL-<br>TAADHR<br>LLEFYLAMPFATPMEAEL-<br>ARRSLAQ<br>KEFTVSGNILT<br>LLEFYLAMPFATPM<br>AGATGGRGPRGAGA | Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9 (2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |
| 6 | BAGE-1 | AARAVFLAL | Boel et al. Immunity. 2(2): 167-75 (1995). |
| 7 | HERV-K-MEL | MLAVISCAV | Schiavetti et al. Cancer Res. 62(19): 5510-6 (2002). |
| 8 | KK-LC-1 | RQKRILVNL | Fukuyama et al. Cancer Res. 66(9): 4922-8 (2006). |
| 9 | KM-HN-1 | NYNNFYRFL<br>EYSKECLKEF<br>EYLSLSDKI | Fukuyama et al. Cancer Res. 66(9): 4922-8 (2006).<br>Monji et al. Clin Cancer Res. 10(18 Pt 1): 6047-57 (2004). |
| 10 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVP-R<br>AADHRQLQLSISSCLQQL<br>CLSRRPWKRSWSAGSCPG-MPHL<br>ILSRDAAPLPRPG<br>AGATGGRGPRGAGA | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 11 | MAGE-A1 | EADPTGHSY<br>KVLEYVIKV<br>SLFRAVITK<br>EVDGREHSA<br>RVRFFFPSL<br>EADPTGHSY<br>REPVTKAEML<br>KEADPTGHSY<br>DPARYEFLW<br>ITKKVADLVGF<br>SAFPTTINF<br>SAYGEPRKL<br>RVRFFFPSL<br>TSCILESLFRAVITK<br>PRALAETSYVKVLEY<br>FLLLKYRAREPVTKAE<br>EYVIKVSARVRF | Traversari et al. J Exp Med. 176(5): 1453-7(1992).<br>Ottaviani et al. Cancer Immunol Immunother. 54(12): 1214-20 (2005).<br>Pascolo et al. Cancer Res. 61(10): 4072-7 (2001).<br>Chaux et al. J Immunol. 163(5): 2928-36 (1999).<br>Luiten et al. Tissue Anitgens. 55(2): 49-52 (2000).<br>Luiten et al. Tissue Antigens. 56(1): 77-81 (2000).<br>Tanzarella et al. Cancer Res. 59(11): 2668-74 (1999).<br>Stroobant et al. Eur J Immunol. 42(6): 1417-28 (2012).<br>Corbiere et al. Tissue Antigens. 63(5): 453-7 (2004).<br>Goodyear et al. Cancer Immunol Immunother. 60(12): 1751-61 (2011).<br>van der Bruggen et al. Eur J Immunol. 24(9): 2134-40 (1994). |

TABLE B-continued

Breast cancer

| No. | Tumor-associated antigen | Reported immunogenic epitopes | Sources |
|---|---|---|---|
| | | | Wang et al. Cancer Immunol Immunother. 56(6): 807-18 (2007). |
| | | | Chaux et al. J Exp Med. 189(5): 767-78 (1999). |
| | | | Chaux et al. Eur J Immunol. 31(6): 1910-6 (2001). |
| 12 | MAGE-A2 | YLQLVFGIEV<br>EYLQLVFGI<br>REPVTKAEML<br>EGDCAPEEK<br>LLKYRAREPVTKAE | Kawashima et al. Hum Immunol. 59(1)1-14 (1998).<br>Tahara et al. Clin Cancer Res. 5(8): 2236-41 (1999).<br>Tanzarella et al. Cancer Res. 59(11): 2668-74(1999).<br>Breckpot et al. J Immunol. 172(4): 2232-7 (2004).<br>Chaux et al. J Exp Med. 89(5): 767-78 (1999). |
| 13 | mucink | PDTRPAPGSTAPPAHGVTSA | Jerome et al. J Immunol. 151(3): 1654-62 (1993). |
| 14 | Sp17 | ILDSSEEDK | Chiriva-Internati et al. Int J Cancer. 107(5): 863-5 (2003). |
| 15 | SSX-2 | KASEKIFYV<br>EKIQKAFDDIAKYFSK<br>FGRLQGISPKI<br>WEKMKASEKIFYVYMKRK<br>KIFYVYMKRKYEAMT<br>KIFYVYMKRKYEAM | Ayyoub et al. J Immunol. 168(4): 1717-22 (2002).<br>Ayyoub et al. J Immunol. 172(11): 7206-11 (2004).<br>Neumann et al. Cancer Immunol Immunother. 60(9): 1333-46 (2011).<br>Ayyoub et al. Clin Immunol. 114(1): 70-8 (2005).<br>Neumann et al. Int J Cancer. 112(4): 661-8 (2004).<br>Ayyoub et al. J Clin Invest. 113(8): 1225-33 (2004). |
| 16 | TAG-1 | SLGWLFLLL<br>LSRLSNRLL | Adair et al. J Immunother. 31(1): 7-17 (2008). |
| 17 | TAG-2 | LSRLSNRLL | Adair et al. J Immunother. 31(1): 7-17 (2008). |
| 18 | TRAG-3 | CEFHACWPAFTVLGE | Janjic et al. J Immunol. 177(4): 2717-27 (2006). |
| 19 | Her2/Neu | HLYQGCQVV<br>YLVPQQGFFC<br>PLQPEQLQV<br>TLEEITGYL<br>ALIHHNTHL<br>PLTSIISAV<br>VLRENTSPK<br>TYLPTNASL | Nakatsuka et al. Mod. Pathol. 19(6): 804-814 (2006).<br>Pils et al. Br. J. Cancer 96(3): 485-91 (2007).<br>Scardino et al. Eur J Immunol. 31(11): 3261-70 (2001).<br>Scardino et al. J Immunol. 168(11): 5900-6 (2002).<br>Kawashima et al. Cancer Res. 59(2): 431-5 (1999).<br>Okugawa et al. Eur J Immunol. 30(11): 3338-46 (2000). |
| 20 | c-myc | | Reuschenbach et al. Cancer Immunol. Immunother. 58: 1535-1544 (2009) |
| 21 | cyclin B1 | | Reuschenbach et al. Cancer Immunol. Immunother. 58: 1535-1544 (2009) |
| 22 | MUC1 | | Reuschenbach et al. Cancer Immunol. Immunother. 58: 1535-1544 (2009) |
| 23 | p53 | VVPCEPPEV | Hung et al. Immunol. Rev. 222: 43-69 (2008).<br>http://cancerimmunity.org/peptide/mutations/ |
| 24 | p62 | | Reuschenbach et al. Cancer Immunol. Immunother. 58: 1535-1544 (2009) |

TABLE B-continued

Breast cancer

| No. | Tumor-associated antigen | Reported immunogenic epitopes | Sources |
|---|---|---|---|
| 25 | Survivin | | Reuschenbach et al. Cancer Immunol. Immunother. 58: 1535-1544 (2009) |

TABLE C

Testicular cancer

| No. | Tumor-associated antigen | Reported immunogenic epitopes | Sources |
|---|---|---|---|
| 1 | CD45 | KFLDALISL | Tomita et al. Cancer Sci. 102(4):697-705 (2011). |
| 2 | DKK1 | ALGGHPLLGV | Qian et al. Blood. (5):1587-94 (2007). |
| 3 | PRAME | VLDGLDVLL, SLYSFPEPEA, ALYVDSLFFL, SLLQHLIGL, LYVDSLFFL | Kessler et al. J Exp Med. 193(1):73-88 (2001). Ikeda et al. Immunity 6(2):199-208 (1997). |
| 4 | RU2AS | LPRWPPPQL | Van Den Eynde et al. J. Exp. Med. 190(12):1793-800 (1999). |
| 5 | Telomerase | ILAKFLHWL; RLVDDFLLV; RPGLLGASVLGLDDI; and LTDLQPYMRQFVAHL | Vonderheide et al. Immunity 10(6):673-9 (1999). Miney et al. Proc. Natl. Acad. Sci. U.S.A. 97(9):4796-801 (2000). Schroers et al. Cancer Res. 62(9):2600-5 (2002). Schroers et al. Clin. Cancer Res. 9(13):4743-55 (2003). |

TABLE D

Pancreatic cancer

| No. | Tumor-associated antigen | Reported immunogenic epitopes | Sources |
|---|---|---|---|
| 1 | ENAH (hMena) | TMNGSKSPV | Di Modugno et al. Int. J. Cancer. 109(6):909-18 (2004). |
| 2 | PBF | CTACRWKKACQR | Tsukahara et al. Cancer Res. 64(15):5442-8 (2004). |
| 3 | K-ras | VVVGAVGVG | Gjertsen et al. Int. J. Cancer. 72(5):784-90 (1997). |
| 4 | Mesothelin | SLLFLLFSL VLPLTVAEV ALQGGGPPY LYPKARLAF AFLPWHRLF | Le et al. Clin. Cancer Res. 18(3):858-68 (2012). Hassan et al. Appl. Immunohistochem. Mol. Morphol. 13(3):243-7 (2005). Thomas et al J Exp Med. 2004 Aug. 2; 200(3): 297-306. |
| 5 | mucink | PDTRPAPGSTAPPAHGVTSA | Jerome et al. J Immunol. 151(3):1654-62 (1993). |

TABLE E

Liver cancer

| No. | Tumor-associated antigen | Reported immunogenic epitopes | Sources |
|---|---|---|---|
| 1 | G250/MN/CAIX | HLSTAFARV; KIFGSLAFL; IISAVVGIL; ALCRWGLLL; ILHNGAYSL; RLLQETELV; VVKGVVFGI; and YMIMVKCWMI | Vissers et al. Cancer Res. 59(21):5554-9 (1999). Fisk et al. J Exp Med. 181(6):2109-17 (1995). Brossart et al. Cancer Res. 58(4):732-6 (1998). Kawashima et al. Hum Immunol. 59(1)1-14 (1998). Rongcun et al. J Immunol. 163(2):1037-44 (1999). |
| 2 | Hepsin | SLLSGDWVL; GLQLGVQAV; and PLTEYIQPV | Guo et al. Scand J Immunol. 78(3):248-57 (2013). |
| 3 | Intestinal carboxyl esterase | SPRWWPTCL | Ronsin et al. J Immunol. 163(1):483-90 (1999). |
| 4 | alpha-foetoprotein | GVALQTMKQ; FMNKFIYEI; and QLAVSVILRV | Butterfield et al. Cancer Res. 59(13):3134-42 (1999). Pichard et al. J Immunother. 31(3):246-53 (2008) Alisa et al. Clin. Cancer Res. 11(18):6686-94 (2005). |
| 5 | M-CSF | LPAVVGLSPGEQEY | Probst-Kepper et al. J Exp Med. 193(10):1189-98 (2001). |
| 6 | PBF | CTACRWKKACQR | Tsukahara et al. Cancer Res. 64(15):5442-8 (2004). |
| 7 | PSMA | NYARTEDFF | Horiguchi et al. Clin Cancer Res. 8(12):3885-92 (2002). |
| 8 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL) SLLMWITQC MLMAQEALAFL YLAMPFATPME ASGPGGGAPR LAAQERRVPR TVSGNILTIR APRGPHGGAASGL MPFATPMEAEL KEFTVSGNILTI MPFATPMEA FATPMEAEL FATPMEAELAR LAMPFATPM ARGPESRLL SLLMWITQCFLPVF LLEFYLAMPFATPMEAELARRSLAQ EFYLAMPFATPM PGVLLKEFTVSGNILTIRLTAADHR RLLEFYLAMPFA QGAMLAAQERRVPRAAEVPR PFATPMEAELARR PGVLLKEFTVSGNILTIRLT VLLKEFTVSG AADHRQLQLSISSCLQQL LKEFTVSGNILTIRL PGVLLKEFTVSGNILTIRLTAADHR LLEFYLAMPFATPMEAELARRSLAQ KEFTVSGNILT LLEFYLAMPFATPM AGATGGRGPRGAGA | Jager et al. Proc. Natl. Acad. Scie. U.S.A. 103(39):14453-8 (2006). Gnjatic et al. PNAS Sep. 26, 2000 vol. 97 no. 20 p. 10919 Jager et al. J Exp Med. 187(2):265-70 (1998). Chen et al. J Immunol. 165(2):948-55 (2000). Valmori et al. Cancer Res. 60(16):4499-506 (2000). Aarnoudse et al. Int J Cancer. 82(3):442-8 (1999). Eikawa et al. Int J Cancer. 132(2):345-54 (2013). Wang et al. J Immunol. 161(7):3598-606 (1998). Matsuzaki et al. Cancer Immunol Immunother. 57(8)1185-95 (2008). Ebert et al. Cancer Res. 69(3):1046-54 (2009). Eikawa et al. Int J Cancer. 132(2):345-54 (2013). Knights et al. Cancer Immunol Immunother. 58(3):325-38 (2009). Jäger et al. Cancer Immun. 2:12 (2002). Zeng et al. Proc Natl Acad Sci USA. 98(7):3964-9 (2001). Mandic et al. J Immunol. 174(3):1751-9 (2005). Chen et al. Proc Natl Acad Sci USA. 101(25):9363-8 (2004). Ayyoub et al. Clin Cancer Res. 16(18):4607-15 (2010). Slager et al. J Immunol. 172(8):5095-102 (2004). Mizote et al. Vaccine. 28(32):5338-46 (2010). Jager et al. J Exp Med. 191(4):625-30 (2000). |

TABLE E-continued

| | Liver cancer | | |
|---|---|---|---|
| No. | Tumor-associated antigen | Reported immunogenic epitopes | Sources |
| | | | Zarour et al. Cancer Res. 60(17):4946-52 (2000). Zeng et al. J Immunol. 165(2):1153-9 (2000). Bioley et al. Clin Cancer Res. 15(13):4467-74 (2009). Zarour et al. Cancer Res. 62(1):213-8 (2002). Hasegawa et al. Clin Cancer Res. 12(6):1921-7 (2006). |
| 9 | LAGE-1 | MLMAQEALAFL SLLMWITQC LAAQERRVPR ELVRRILSR APRGVRMAV SLLMWITQCFLPVF QGAMLAAQERRVPRAAEVPR AADHRQLQLSISSCLQQL CLSRRPWKRSWSAGSCPGMPHL ILSRDAAPLPRPG AGATGGRGPRGAGA | Aarnoudse et al. Int J Cancer. 82(3):442-8 (1999). Rimoldi et al. J Immunol. 165(12):7253-61 (2000). Wang et al. J Immunol. 161(7):3598-606 (1998). Sun et al. Cancer Immunol Immunother. 55(6):644-52 (2006). Slager et al. Cancer Gene Ther. 11(3):227-36 (2004). Zeng et al. Proc Natl Acad Sci USA. 98(7):3964-9 (2001). Slager et al. J Immunol. 172(8):5095-102 (2004). Jager et al. J Exp Med. 191(4):625-30 (2000). Slager et al. J Immunol. 170(3):1490-7 (2003). Wang et al. Immunity. 20(1):107-18 (2004). Hasegawa et al. Clin Cancer Res. 12(6):1921-7 (2006). |
| 10 | HERV-K-MEL | MLAVISCAV | Schiavetti et al. Cancer Res. 62(19):5510-6 (2002). |
| 11 | KK-LC-1 | RQKRILVNL | Fukuyama et al. Cancer Res. 66(9):4922-8 (2006). |
| 12 | KM-HN-1 | NYNNFYRFL EYSKECLKEF EYLSLSDKI | Fukuyama et al. Cancer Res. 66(9):4922-8 (2006). Monji et al. Clin Cancer Res. 10(18 Pt 1):6047-57 (2004). |
| 13 | Sp17 | ILDSSEEDK | Chiriva-Internati et al. Int J Cancer. 107(5):863-5 (2003). |
| 14 | c-myc | | Reuschenbach et al. Cancer Immunol. Immunother. 58:1535-1544 (2009) |
| 15 | cyclin B1 | | Reuschenbach et al. Cancer Immunol. Immunother. 58:1535-1544 (2009) |
| 16 | p53 | VVPCEPPEV | Hung et al. Immunol. Rev. 222:43-69 (2008). http://cancerimmunity.org/peptide/mutations/ |
| 17 | p62 | | Reuschenbach et al. Cancer Immunol. Immunother. 58:1535-1544 (2009) |
| 18 | Survivin | | Reuschenbach et al. Cancer Immunol. Immunother. 58:1535-1544 (2009) |

TABLE F

| | Colorectal cancer | | |
|---|---|---|---|
| No. | Tumor-associated antigen | Reported immunogenic epitopes | Sources |
| 1 | ENAH (hMena) | TMNGSKSPV | Di Modugno et al. Int. J Cancer. 109(6):909-18 (2004). |
| 2 | Intestinal carboxyl esterase | SPRWWPTCL | Ronsin et al. J Immunol. 163(1):483-90 (1999). |
| 3 | CASP-5 | FLIIWQNTM | Schwitalle et al. Cancer Immun. 4:14 (2004). |
| 4 | COA-1 | TLYQDDTLTLQAAG | Maccalli et al. Cancer Res. 63(20):6735-43 (2003). |
| 5 | OGT | SLYKFSPFPL | Ripberger. J Clin Immunol. 23(5):415-23 (2003). |
| 6 | OS-9 | KELEGILLL | Vigneron et al. Cancer Immun. 2:9 (2002). |
| 7 | TGF-betaRII | RLSSCVPVA | Linnebacher et al. Int. J. Cancer. 93(1):6-11 (2001). |
| 8 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL) SLLMWITQC MLMAQEALAFL YLAMPFATPME ASGPGGGAPR LAAQERRVPR TVSGNILTIR APRGPHGGAASGL MPFATPMEAEL KEFTVSGNILTI MPFATPMEA FATPMEAEL FATPMEAELAR LAMPFATPM ARGPESRLL SLLMWITQCFLPVF LLEFYLAMPFATPMEAELARRSLAQ EFYLAMPFATPM PGVLLKEFTVSGNILTIRLTAADHR RLLEFYLAMPFA QGAMLAAQERRVPRAAEVPR PFATPMEAELARR PGVLLKEFTVSGNILTIRLT VLLKEFTVSG AADHRQLQLSISSCLQQL LKEFTVSGNILTIRL PGVLLKEFTVSGNILTIRLTAADHR LLEFYLAMPFATPMEAELARRSLAQ KEFTVSGNILT LLEFYLAMPFATPM AGATGGRGPRGAGA | Jager et al. Proc. Natl. Acad. Scie. U.S.A. 103(39):14453-8 (2006). Gnjatic et al. PNAS Sep. 26, 2000 vol. 97 no. 20 p. 10919 Jager et al. J Exp Med. 187(2):265-70 (1998). Chen et al. J Immunol. 165(2):948-55 (2000). Valmori et al. Cancer Res. 60(16):4499-506 (2000). Aarnoudse et al. Int J Cancer. 82(3):442-8(1999). Eikawa et al. Int J Cancer. 132(2):345-54 (2013). Wang et al. J Immunol. 161(7):3598-606 (1998). Matsuzaki et al. Cancer Immunol Immunother. 57(8)1185-95 (2008). Ebert et al. Cancer Res. 69(3):1046-54 (2009). Eikawa et al. Int J Cancer. 132(2):345-54 (2013). Knights et al. Cancer Immunol Immunother. 58(3):325-38 (2009). Jäger et al. Cancer Immun. 2:12 (2002). Zeng et al. Proc Natl Acad Sci USA. 98(7):3964-9 (2001). Mandic et al. J Immunol. 174(3):1751-9 (2005). Chen et al. Proc Natl Acad Sci USA. 101(25):9363-8 (2004). Ayyoub et al. Clin Cancer Res. 16(18):4607-15 (2010). Slager et al. J Immunol. 172(8):5095-102 (2004). Mizote et al. Vaccine. 28(32):5338-46 (2010). Jager et al. J Exp Med. 191(4):625-30 (2000). Zarour et al. Cancer Res. 60(17):4946-52 (2000). Zeng et al. J Immunol. 165(2):1153-9 (2000). Bioley et al. Clin Cancer Res. 15(13):4467-74 (2009). Zarour et al. Cancer Res. 62(1):213-8 (2002). Hasegawa et al. Clin Cancer Res. 12(6):1921-7 (2006). |

TABLE F-continued

Colorectal cancer

| No. | Tumor-associated antigen | Reported immunogenic epitopes | Sources |
|---|---|---|---|
| 9 | CEA | TYYRPGVNLSLSC<br>EIIYPNASLLIQN<br>YACFVSNLATGRNNS<br>LWWVNNQSLPVSP<br>LWWVNNQSLPVSP<br>LWWVNNQSLPVSP<br>EIIYPNASLLIQN<br>NSIVKSITVSASG<br>KTWGQYWQV<br>(A)MLGTHTMEV<br>ITDQVPFSV<br>YLEPGPVTA<br>LLDGTATLRL<br>VLYRYGSFSV<br>SLADTNSLAV<br>RLMKQDFSV<br>RLPRIFCSC<br>LIYRRRLMK<br>ALLAVGATK<br>IALNFPGSQK<br>RSYVPLAHR | Duffy, Clin. Chem.<br>47(4):624-30 (2001).<br>Parkhurst et al. Mol. Ther.<br>19(3):620-6 (2011).<br>Galanis et al. Cancer Res.<br>70(3):875-82 (2010).<br>Bast et al. Am. J. Obstet. Gynecol.<br>149(5):553-9 (1984).<br>Crosti et al. J Immunol.<br>176(8):5093-9 (2006).<br>Kobayashi et al. Clin Cancer Res.<br>8(10):3219-25 (2002).<br>Campi et al. Cancer Res.<br>63(23):8481-6 (2003).<br>Bakker et al. Int J Cancer.<br>62(1):97-102 (1995).<br>Tsai et al. J Immunol.<br>158(4):1796-802 (1997).<br>Kawakami et al. J Immunol.<br>154(8):3961-8 (1995).<br>Cox et al. Science.<br>264(5159):716-9 (1994).<br>Kawakami et al. J Immunol.<br>154(8):3961-8 (1995).<br>Kawakami et al. J Immunol.<br>161(12):6985-92 (1998).<br>Skipper et al. J Immunol.<br>157(11):5027-33 (1996).<br>Michaux et al. J Immunol.<br>192(4):1962-71 (2014). |
| 10 | HER V-K-MEL | MLAVISCAV | Schiavetti et al. Cancer Res.<br>62(19):5510-6 (2002). |
| 11 | KK-LC-1 | RQKRILVNL | Fukuyama et al. Cancer Res.<br>66(9):4922-8 (2006). |
| 12 | KM-HN-1 | NYNNFYRFL<br>EYSKECLKEF<br>EYLSLSDKI | Fukuyama et al. Cancer Res.<br>66(9):4922-8 (2006).<br>Monji et al. Clin Cancer Res.<br>10(18 Pt 1):6047-57 (2004). |
| 13 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer.<br>82(3):442-8 (1999).<br>Rimoldi et al. J Immunol.<br>165(12):7253-61 (2000).<br>Wang et al. J Immunol.<br>161(7):3598-606 (1998).<br>Sun et al. Cancer Immunol Immunother.<br>55(6):644-52 (2006).<br>Slager et al. Cancer Gene Ther.<br>11(3):227-36 (2004).<br>Zeng et al. Proc Natl Acad Sci USA.<br>98(7):3964-9 (2001).<br>Slager et al. J Immunol.<br>172(8):5095-102 (2004).<br>Jager et al. J Exp Med.<br>191(4):625-30 (2000).<br>Slager et al. J Immunol.<br>170(3):1490-7 (2003).<br>Wang et al. Immunity.<br>20(1):107-18 (2004).<br>Hasegawa et al. Clin Cancer Res.<br>12(6):1921-7 (2006). |
| 14 | MAGE-A2 | YLQLVFGIEV<br>EYLQLVFGI<br>REPVTKAEML<br>EGDCAPEEK<br>LLKYRAREPVTKAE | Kawashima et al. Hum Immunol.<br>59(1):1-14 (1998).<br>Tahara et al. Clin Cancer Res.<br>5(8):2236-41 (1999).<br>Tanzarella et al. Cancer Res.<br>59(11):2668-74 (1999). |

TABLE F-continued

Colorectal cancer

| No. | Tumor-associated antigen | Reported immunogenic epitopes | Sources |
|---|---|---|---|
| | | | Breckpot et al. J Immunol. 172(4):2232-7 (2004). Chaux et al. J Exp Med. 89(5):767-78 (1999). |
| 15 | Sp17 | ILDSSEEDK | Chiriva-Internati et al. Int J Cancer. 107(5):863-5 (2003). |
| 16 | TAG-1 | SLGWLFLLL LSRLSNRLL | Adair et al. J Immunother. 31(1):7-17 (2008). |
| 17 | TAG-2 | LSRLSNRLL | Adair et al. J Immunother. 31(1):7-17 (2008). |
| 18 | c-myc | | Reuschenbach et al. Cancer Immunol. Immunother. 58:1535-1544 (2009) |
| 19 | cyclin B1 | | Reuschenbach et al. Cancer Immunol. Immunother. 58:1535-1544 (2009) |
| 20 | MUC1 | | Reuschenbach et al. Cancer Immunol. Immunother. 58:1535-1544 (2009) |
| 21 | p53 | VVPCEPPEV | Hung et al. Immunol. Rev. 222:43-69 (2008). http://cancerimmunity.org/peptide/mutations/ |
| 22 | p62 | | Reuschenbach et al. Cancer Immunol. Immunother. 58:1535-1544 (2009) |
| 23 | Survivin | | Reuschenbach et al. Cancer Immunol. Immunother. 58:1535-1544 (2009) |
| 24 | gp70 | | Castle et al., BMC Genomics 15:190 (2014) |

TABLE G

Thyroid cancer

| No. | Tumor-associated antigen | Reported immunogenic epitopes | Sources |
|---|---|---|---|
| 1 | CALCA | VLLQAGSLHA | El Hage et al. Proc. Natl. Acad. Sci. U.S.A. 105(29):10119-24 (2008). |
| 2 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL) SLLMWITQC MLMAQEALAFL YLAMPFATPME ASGPGGGAPR LAAQERRVPR TVSGNILTIR APRGPHGGAASGL MPFATPMEAEL KEFTVSGNILTI MPFATPMEA FATPMEAEL FATPMEAELAR LAMPFATPM ARGPESRLL SLLMWITQCFLPVF LLEFYLAMPFATPMEAELARRSLAQ EFYLAMPFATPM PGVLLKEFTVSGNILTIRLTAADHR RLLEFYLAMPFA | Jager et al. Proc. Natl. Acad. Scie. U.S.A. 103(39):14453-8 (2006). Gnjatic et al. PNAS Sep. 26, 2000 vol. 97 no. 20 p. 10919 Jager et al. J Exp Med. 187(2):265-70 (1998). Chen et al. J Immunol. 165(2):948-55 (2000). Valmori et al. Cancer Res. 60(16):4499-506 (2000). Aarnoudse et al. Int J Cancer. 82(3):442-8 (1999). Eikawa et al. Int J Cancer. 132(2):345-54 (2013). Wang et al. J Immunol. 161(7):3598-606 (1998). Matsuzaki et al. Cancer Immunol Immunother. 57(8)1185-95 (2008). Ebert et al. Cancer Res. 69(3):1046-54 (2009). Eikawa et al. Int J Cancer. 132(2):345-54 (2013). Knights et al. Cancer Immunol Immunother. 58(3):325-38 (2009). Jäger et al. Cancer Immun. 2:12 (2002). |

TABLE G-continued

| | | Thyroid cancer | |
|---|---|---|---|
| No. | Tumor-associated antigen | Reported immunogenic epitopes | Sources |
| | | QGAMLAAQERRVPRAAEVPR<br>PFATPMEAELARR<br>PGVLLKEFTVSGNILTIRLT<br>VLLKEFTVSG<br>AADHRQLQLSISSCLQQL<br>LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | Zeng et al. Proc Natl Acad Sci USA.<br>98(7):3964-9 (2001).<br>Mandic et al. J Immunol.<br>174(3):1751-9 (2005).<br>Chen et al. Proc Natl Acad Sci USA.<br>101(25):9363-8 (2004).<br>Ayyoub et al. Clin Cancer Res.<br>16(18):4607-15 (2010).<br>Slager et al. J Immunol.<br>172(8):5095-102 (2004).<br>Mizote et al. Vaccine.<br>28(32):5338-46 (2010).<br>Jager et al. J Exp Med.<br>191(4):625-30 (2000).<br>Zarour et al. Cancer Res.<br>60(17):4946-52 (2000).<br>Zeng et al. J Immunol.<br>165(2):1153-9 (2000).<br>Bioley et al. Clin Cancer Res.<br>15(13):4467-74 (2009).<br>Zarour et al. Cancer Res.<br>62(1):213-8 (2002).<br>Hasegawa et al. Clin Cancer Res.<br>12(6):1921-7 (2006). |
| 3 | HERV-K-MEL | MLAVISCAV | Schiavetti et al. Cancer Res.<br>62(19):5510-6 (2002). |
| 4 | KK-LC-1 | RQKRILVNL | Fukuyama et al. Cancer Res.<br>66(9):4922-8 (2006). |
| 5 | KM-HN-1 | NYNNFYRFL<br>EYSKECLKEF<br>EYLSLSDKI | Fukuyama et al. Cancer Res.<br>66(9):4922-8 (2006).<br>Monji et al. Clin Cancer Res.<br>10(18 Pt 1):6047-57 (2004). |
| 6 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer.<br>82(3):442-8 (1999).<br>Rimoldi et al. J Immunol.<br>165(12):7253-61 (2000).<br>Wang et al. J Immunol.<br>161(7):3598-606 (1998).<br>Sun et al. Cancer Immunol Immunother.<br>55(6):644-52 (2006).<br>Slager et al. Cancer Gene Ther.<br>11(3):227-36 (2004).<br>Zeng et al. Proc Natl Acad Sci USA.<br>98(7):3964-9 (2001).<br>Slager et al. J Immunol.<br>172(8):5095-102 (2004).<br>Jager et al. J Exp Med.<br>191(4):625-30 (2000).<br>Slager et al. J Immunol.<br>170(3):1490-7 (2003).<br>Wang et al. Immunity.<br>20(1):107-18 (2004).<br>Hasegawa et al. Clin Cancer Res.<br>12(6):1921-7 (2006). |
| 7 | Sp17 | ILDSSEEDK | Chiriva-Internati et al. Int J Cancer.<br>107(5):863-5 (2003). |

TABLE H

Lung cancer

| No. | Tumor-associated antigen | Reported immunogenic epitopes | Sources |
|---|---|---|---|
| 1 | CD274 | LLNAFTVTV | Munir et al. Cancer Res. 73(6):1764-76 (2013). |
| 2 | mdm-2 | VLFYLGQY | Asai et al. Cancer Immun. 2:3 (2002). |
| 3 | alpha-actinin-4 | FIASNGVKLV | Echchakir et al. Cancer Res. 61(10):4078-83 (2001). |
| 4 | Elongation factor 2 (squamous cell carcinoma of the lung) | ETVSEQSNV | Hogan et al. Cancer Res. 58(22):5144-50 (1998). |
| 5 | ME1 (non-small cell lung carcinoma) | FLDEFMEGV | Karanikas et al. Cancer Res. 61(9):3718-24 (2001). |
| 6 | NFYC (squamous cell carcinoma of the lung) | QQITKTEV | Takenoyama et al. Int. J Cancer. 118(8):1992-7 (2006). |
| 7 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL) SLLMWITQC MLMAQEALAFL YLAMPFATPME ASGPGGGAPR LAAQERRVPR TVSGNILTIR APRGPHGGAASGL MPFATPMEAEL KEFTVSGNILTI MPFATPMEA FATPMEAEL FATPMEAELAR LAMPFATPM ARGPESRLL SLLMWITQCFLPVF LLEFYLAMPFATPMEAELARRSLAQ EFYLAMPFATPM PGVLLKEFTVSGNILTIRLTAADHR RLLEFYLAMPFA QGAMLAAQERRVPRAAEVPR PFATPMEAELARR PGVLLKEFTVSGNILTIRLT VLLKEFTVSG AADHRQLQLSISSCLQQL LKEFTVSGNILTIRL PGVLLKEFTVSGNILTIRLTAADHR LLEFYLAMPFATPMEAELARRSLAQ KEFTVSGNILT LLEFYLAMPFATPM AGATGGRGPRGAGA | Jager et al. Proc. Natl. Acad. Scie. U.S.A. 103(39):14453-8 (2006). Gnjatic et al. PNAS Sep. 26, 2000 vol. 97 no. 20 p. 10919 Jager et al. J Exp Med. 187(2):265-70 (1998). Chen et al. J Immunol. 165(2):948-55 (2000). Valmori et al. Cancer Res. 60(16):4499-506 (2000). Aarnoudse et al. Int J Cancer. 82(3):442-8 (1999). Eikawa et al. Int J Cancer. 132(2):345-54 (2013). Wang et al. J Immunol. 161(7):3598-606 (1998). Matsuzaki et al. Cancer Immunol Immunother. 57(8)1185-95 (2008). Ebert et al. Cancer Res. 69(3):1046-54 (2009). Eikawa et al. Int J Cancer. 132(2):345-54 (2013). Knights et al. Cancer Immunol Immunother. 58(3):325-38 (2009). Jäger et al. Cancer Immun. 2:12 (2002). Zeng et al. Proc Natl Acad Sci USA. 98(7):3964-9 (2001). Mandic et al. J Immunol. 174(3):1751-9 (2005). Chen et al. Proc Natl Acad Sci USA. 101(25):9363-8 (2004). Ayyoub et al. Clin Cancer Res. 16(18):4607-15 (2010). Slager et al. J Immunol. 172(8):5095-102 (2004). Mizote et al. Vaccine. 28(32):5338-46 (2010). Jager et al. J Exp Med. 191(4):625-30 (2000). Zarour et al. Cancer Res. 60(17):4946-52 (2000). Zeng et al. J Immunol. 165(2):1153-9 (2000). Bioley et al. Clin Cancer Res. 15(13):4467-74 (2009). Zarour et al. Cancer Res. 62(1):213-8 (2002). Hasegawa et al. Clin Cancer Res. 12(6):1921-7 (2006). |

TABLE H-continued

Lung cancer

| No. | Tumor-associated antigen | Reported immunogenic epitopes | Sources |
|---|---|---|---|
| 8 | GAGE-1,2,8 | YRPRPRRY | Van den Eynde et al. J Exp Med. 182(3):689-98 (1995). |
| 9 | HERV-K-MEL | MLAVISCAV | Schiavetti et al. Cancer Res. 62(19):5510-6 (2002). |
| 10 | KK-LC-1 | RQKRILVNL | Fukuyama et al. Cancer Res. 66(9):4922-8 (2006). |
| 11 | KM-HN-1 | NYNNFYRFL<br>EYSKECLKEF<br>EYLSLSDKI | Fukuyama et al. Cancer Res. 66(9):4922-8 (2006).<br>Monji et al. Clin Cancer Res. 10(18 Pt 1):6047-57 (2004). |
| 12 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer. 82(3):442-8 (1999).<br>Rimoldi et al. J Immunol. 165(12):7253-61 (2000).<br>Wang et al. J Immunol. 161(7):3598-606 (1998).<br>Sun et al. Cancer Immunol Immunother. 55(6):644-52 (2006).<br>Slager et al. Cancer Gene Ther. 11(3):227-36 (2004).<br>Zeng et al. Proc Natl Acad Sci USA. 98(7):3964-9 (2001).<br>Slager et al. J Immunol. 172(8):5095-102 (2004).<br>Jager et al. J Exp Med. 191(4):625-30 (2000).<br>Slager et al. J Immunol. 170(3):1490-7 (2003).<br>Wang et al. Immunity. 20(1):107-18 (2004).<br>Hasegawa et al. Clin Cancer Res. 12(6):1921-7 (2006). |
| 13 | MAGE-A2 | YLQLVFGIEV<br>EYLQLVFGI<br>REPVTKAEML<br>EGDCAPEEK<br>LLKYRAREPVTKAE | Kawashima et al. Hum Immunol. 59(1):1-14 (1998).<br>Tahara et al. Clin Cancer Res. 5(8):2236-41 (1999).<br>Tanzarella et al. Cancer Res. 59(11):2668-74(1999).<br>Breckpot et al. J Immunol. 172(4):2232-7 (2004).<br>Chaux et al. J Exp Med. 89(5):767-78 (1999). |
| 14 | MAGE-A6 (squamous cell lung carcinoma) | MVKISGGPR<br>EVDPIGHVY<br>REPVTKAEML<br>EGDCAPEEK<br>ISGGPRISY<br>LLKYRAREPVTKAE | Zorn et al. Eur J Immunol. 29(2):602-7 (1999).<br>Benlalam et al. J Immunol. 171(11):6283-9 (2003).<br>Tanzarella et al. Cancer Res. 59(11):2668-74 (1999).<br>Breckpot et al. J Immunol. 172(4):2232-7 (2004).<br>Vantomme et al. Cancer Immun. 3:17 (2003).<br>Chaux et al. J Exp Med. 189(5):767-78 (1999). |
| 15 | Sp17 | ILDSSEEDK | Chiriva-Internati et al. Int J Cancer. 107(5):863-5 (2003). |
| 16 | TAG-1 | SLGWLFLLL<br>LSRLSNRLL | Adair et al. J Immunother. 31(1):7-17 (2008). |
| 17 | TAG-2 | LSRLSNRLL | Adair et al. J Immunother. 31(1):7-17 (2008). |
| 18 | TRAG-3 | CEFHACWPAFTVLGE | Janjic et al. J Immunol. 177(4):2717-27 (2006). |

TABLE H-continued

Lung cancer

| No. | Tumor-associated antigen | Reported immunogenic epitopes | Sources |
|---|---|---|---|
| 19 | XAGE-1b/GAGED2a (non-small cell lung cancer) | RQKKIRIQL<br>HLGSRQKKIRIQLRSQ<br>CATWKVICKSCISQTPG | Ohue et al. Int J Cancer. 131(5):E649-58 (2012).<br>Shimono et al. Int J Oncol. 30(4):835-40 (2007). |
| 20 | c-myc | | Reuschenbach et al. Cancer Immunol. Immunother. 58:1535-1544 (2009) |
| 21 | cyclin B1 | | Reuschenbach et al. Cancer Immunol. Immunother. 58:1535-1544 (2009) |
| 22 | Her2/Neu | HLYQGCQVV<br>YLVPQQGFFC<br>PLQPEQLQV<br>TLEEITGYL<br>ALIHHNTHL<br>PLTSIISAV<br>VLRENTSPK<br>TYLPTNASL | Nakatsuka et al. Mod. Pathol. 19(6):804-814 (2006).<br>Pils et al. Br. J. Cancer 96(3):485-91 (2007).<br>Scardino et al. Eur J Immunol. 31(11):3261-70 (2001).<br>Scardino et al. J Immunol. 168(11):5900-6 (2002).<br>Kawashima et al. Cancer Res. 59(2):431-5 (1999).<br>Okugawa et al. Eur J Immunol. 30(11):3338-46 (2000). |
| 23 | MUC1 | | Reuschenbach et al. Cancer Immunol. Immunother. 58:1535-1544 (2009) |
| 24 | p53 | VVPCEPPEV | Hung et al. Immunol. Rev. 222:43-69 (2008).<br>http://cancerimmunity.org/peptide/mutations/ |
| 25 | p62 | | Reuschenbach et al. Cancer Immunol. Immunother. 58:1535-1544 (2009) |
| 26 | Survivin | | Reuschenbach et al. Cancer Immunol. Immunother. 58:1535-1544 (2009) |

TABLE I

Prostate cancer

| No. | Tumor-associated antigen | Reported immunogenic epitopes | Sources |
|---|---|---|---|
| 1 | DKK1 | ALGGHPLLGV | Qian et al. Blood. 110(5):1587-94 (2007). |
| 2 | ENAH (hMena) | TMNGSKSPV | Di Modugno et al. Int. J. Cancer. 109(6):909-18 (2004). |
| 3 | Kallikrein 4 | FLGYLILGV;<br>SVSESDTIRSISIAS;<br>LLANGRMPTVLQCVN; and<br>RMPTVLQCVNVSVVS | Wilkinson et al. Cancer Immunol Immunother. 61(2):169-79 (2012).<br>Hural et al. J. Immunol. 169(1):557-65 (2002). |
| 4 | PSMA | NYARTEDFF | Horiguchi et al. Clin Cancer Res. 8(12):3885-92 (2002). |
| 5 | STEAP1 | MIAVFLPIV and<br>HQQYFYKIPILVINK | Rodeberg et al. Clin. Cancer Res. 11(12):4545-52 (2005).<br>Kobayashi et al. Cancer Res. 67(11):5498-504 (2007). |
| 6 | PAP | FLFLLFFWL;<br>TLMSAMTNL; and<br>ALDVYNGLL | Olson et al. Cancer Immunol Immunother. 59(6):943-53 (2010). |
| 7 | PSA (prostate carcinoma) | FLTPKKLQCV and<br>VISNDVCAQV | Correale et al. J Natl. Cancer Inst. 89(4):293-300 (1997). |

TABLE I-continued

Prostate cancer

| No. | Tumor-associated antigen | Reported immunogenic epitopes | Sources |
|---|---|---|---|
| 8 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL)<br>SLLMWITQC<br>MLMAQEALAFL<br>YLAMPFATPME<br>ASGPGGGAPR<br>LAAQERRVPR<br>TVSGNILTIR<br>APRGPHGGAASGL<br>MPFATPMEAEL<br>KEFTVSGNILTI<br>MPFATPMEA<br>FATPMEAEL<br>FATPMEAELAR<br>LAMPFATPM<br>ARGPESRLL<br>SLLMWITQCFLPVF<br>LLEFYLAMPFATPMEAELARRSLAQ<br>EFYLAMPFATPM<br>PGVLLKEFTVSGNILTIRLTAADHR<br>RLLEFYLAMPFA<br>QGAMLAAQERRVPRAAEVPR<br>PFATPMEAELARR<br>PGVLLKEFTVSGNILTIRLT<br>VLLKEFTVSG<br>AADHRQLQLSISSCLQQL<br>LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | Jager et al. Proc. Natl. Acad. Scie. U.S.A. 103(39):14453-8 (2006).<br>Gnjatic et al. PNAS Sep. 26, 2000 vol. 97 no. 20 p. 10919<br>Jager et al. J Exp Med. 187(2):265-70 (1998).<br>Chen et al. J Immunol. 165(2):948-55 (2000).<br>Valmori et al. Cancer Res. 60(16):4499-506 (2000).<br>Aarnoudse et al. Int J Cancer. 82(3):442-8 (1999).<br>Eikawa et al. Int J Cancer. 132(2):345-54 (2013).<br>Wang et al. J Immunol. 161(7):3598-606 (1998).<br>Matsuzaki et al. Cancer Immunol Immunother. 57(8)1185-95 (2008).<br>Ebert et al. Cancer Res. 69(3):1046-54 (2009).<br>Eikawa et al. Int J Cancer. 132(2):345-54 (2013).<br>Knights et al. Cancer Immunol Immunother. 58(3):325-38 (2009).<br>Jäger et al. Cancer Immun. 2:12 (2002).<br>Zeng et al. Proc Natl Acad Sci USA. 98(7):3964-9 (2001).<br>Mandic et al. J Immunol. 174(3):1751-9 (2005).<br>Chen et al. Proc Natl Acad Sci USA. 101(25):9363-8 (2004).<br>Ayyoub et al. Clin Cancer Res. 16(18):4607-15 (2010).<br>Slager et al. J Immunol. 172(8):5095-102 (2004).<br>Mizote et al. Vaccine. 28(32):5338-46 (2010).<br>Jager et al. J Exp Med. 191(4):625-30 (2000).<br>Zarour et al. Cancer Res. 60(17):4946-52 (2000).<br>Zeng et al. J Immunol. 165(2):1153-9 (2000).<br>Bioley et al. Clin Cancer Res. 15(13):4467-74 (2009).<br>Zarour et al. Cancer Res. 62(1):213-8 (2002).<br>Hasegawa et al. Clin Cancer Res. 12(6):1921-7 (2006). |
| 9 | BAGE-1 (non-small cell lung carcinoma) | AARAVFLAL | Boel et al. Immunity. 2(2):167-75 (1995). |
| 10 | GAGE-1,2,8 (non-small cell lunch carcinoma) | YRPRPRRY | Van den Eynde et al. J Exp Med. 182(3):689-98 (1995). |
| 11 | GAGE-3,4,5,6,7 (lung squamous cell carcinoma and lung adenocarcinoma) | YYWPRPRRY | De Backer et al. Cancer Res. 59(13):3157-65 (1999). |
| 12 | HERV-K-MEL | MLAVISCAV | Schiavetti et al. Cancer Res. 62(19):5510-6 (2002). |
| 13 | KK-LC-1 | RQKRILVNL | Fukuyama et al. Cancer Res. 66(9):4922-8 (2006). |
| 14 | KM-HN-1 | NYNNFYRFL<br>EYSKECLKEF<br>EYLSLSDKI | Fukuyama et al. Cancer Res. 66(9):4922-8 (2006).<br>Monji et al. Clin Cancer Res. 10(18 Pt 1):6047-57 (2004). |

TABLE I-continued

Prostate cancer

| No. | Tumor-associated antigen | Reported immunogenic epitopes | Sources |
|---|---|---|---|
| 15 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer. 82(3):442-8 (1999).<br>Rimoldi et al. J Immunol. 165(12):7253-61 (2000).<br>Wang et al. J Immunol. 161(7):3598-606 (1998).<br>Sun et al. Cancer Immunol Immunother. 55(6):644-52 (2006).<br>Slager et al. Cancer Gene Ther. 11(3):227-36 (2004).<br>Zeng et al. Proc Natl Acad Sci USA. 98(7):3964-9 (2001).<br>Slager et al. J Immunol. 172(8):5095-102 (2004).<br>Jager et al. J Exp Med. 191(4):625-30 (2000).<br>Slager et al. J Immunol. 170(3):1490-7 (2003).<br>Wang et al. Immunity. 20(1):107-18 (2004).<br>Hasegawa et al. Clin Cancer Res. 12(6):1921-7 (2006). |
| 16 | Sp17 | ILDSSEEDK | Chiriva-Internati et al. Int J Cancer. 107(5):863-5 (2003). |

TABLE J

Kidney cancer

| No. | Tumor-associated antigen | Reported immunogenic epitopes | Sources |
|---|---|---|---|
| 1 | FGF5 | NTYASPRFK | Hanada et al. Nature. 427(6971):252-6 (2004). |
| 2 | Hepsin | SLLSGDWVL;<br>GLQLGVQAV; and<br>PLTEYIQPV | Guo et al. Scand J Immunol. 78(3):248-57 (2013). |
| 3 | Intestinal carboxyl esterase | SPRWWPTCL | Ronsin et al. J Immunol. 163(1):483-90 (1999). |
| 4 | M-CSF | LPAVVGLSPGEQEY | Probst-Kepper et al. J Exp Med. 193(10):1189-98 (2001). |
| 5 | RU2AS | LPRWPPPQL | Van Den Eynde et al. J. Exp. Med. 190(12):1793-800 (1999). |
| 6 | hsp70-2 (renal cell carcinoma) | SLFEGIDIYT | Gaudin et al. J. Immunol. 162(3):1730-8 (1999). |
| 7 | Mannan-MUC-1 (renal cell carcinoma) | PDTRPAPGSTAPPAHGVTSA<br>STAPPVHNV<br>LLLLTVLTV<br>PGSTAPPAHGVT | Loveland et al. Clin. Cancer Res. 12(3 Pt 1):869-77 (2006).<br>Loveland et al. Clin. Cancer Res. 12(3 Pt 1):869-77 (2006).<br>Godelaine et al. Cancer Immunol Immunother. 56(6):753-9 (2007).<br>Ma et al. Int J Cancer. 129(10):2427-34 (2011).<br>Wen et al. Cancer Sci. 102(8):1455-61 (2011).<br>Jerome et al. J Immunol. 151(3):1654-62 (1993).<br>Brossart et al. Blood. 93(12):4309-17 (1999).<br>Hiltbold et al. Cancer Res. 58(22):5066-70 (1998). |

TABLE J-continued

| | | Kidney cancer | |
|---|---|---|---|
| No. | Tumor-associated antigen | Reported immunogenic epitopes | Sources |
| 8 | MAGE-A9 (renal cell carcinoma) | ALSVMGVYV | Oehlrich et al. Int J Cancer. 117(2):256-64 (2005). |

TABLE K

| | | Melanoma | |
|---|---|---|---|
| No. | Tumor-associated antigen | Reported immunogenic epitopes | Sources |
| 1 | Hepsin | SLLSGDWVL; GLQLGVQA; and PLTEYIQPV | Guo et al. Scand J Immunol. 78(3):248-57 (2013). |
| 2 | ARTC1 | YSVYFNLPADTIYTN | Wang et al J Immunol. 174(5):2661-70 (2005). |
| 3 | B-RAF | EDLTVKIGDFGLATEKSRWSG SHQFEQLS | Sharkey et al. Cancer Res. 64(5):1595-9 (2004). |
| 4 | beta-catenin | SYLDSGIHF | Robbins et al. J. Exp. Med. 183(3):1185-92 (1996). |
| 5 | Cdc27 | FSWAMDLDPKGA | Wang et al. Science. 284(5418):1351-4 (1999). |
| 6 | CDK4 | ACDPHSGHFV | Wölfel et al. Science. 269(5228):1281-4 (1995). |
| 7 | CDK12 | CILGKLFTK | Robbins et al. Nat Med. 19(6):747-52. (2013). |
| 8 | CDKN2A | AVCPWTWLR | Huang et al. J Immunol. 172(10):6057-64 (2004). |
| 9 | CLPP | ILDKVLVHL | Corbière et al. Cancer Res. 71(4):1253-62(2011). |
| 10 | CSNK1A1 | GLFGDIYLA | Robbins et al. Nat Med. 19(6):747-52 (2013). |
| 11 | FN1 | MIFEKHGFRRTTPP | Wang et al. J Exp Med. 195(11):1397-406 (2003). |
| 12 | GAS7 | SLADEAEVYL | Robbins, et al. Nat Med. 19(6):747-52 (2013). |
| 13 | GPNMB | TLDWLLQTPK | Lennerz et al. Proc. Natl. Acad. Sci. U.S.A. 102(44):16013-8 (2005). |
| 14 | HAUS3 | ILNAMIAKI | Robbins et al. Nat Med. 19(6):747-52 (2013). |
| 15 | LDLR-fucosyltransferase | WRRAPAPGA and PVTWRRAPA | Wang et al. J Exp Med. 189(10):1659-68 (1999). |
| 16 | MART2 | FLEGNEVGKTY | Kawakami et al. J Immunol. 166(4):2871-7 (2001). |
| 17 | MATN | KTLTSVFQK | Robbins et al. Nat Med. 19(6):747-52 (2013). |
| 18 | MUM-1 | EEKLIVVLF | Coulie et al. Proc. Natl. Acad. Sci. U.S.A. 92(17):7976-80 (1995). |
| 19 | MUM-2 | SELFRSGLDSY and FRSGLDSYV | Chiari et al. Cancer Res. 59(22):5785-92 (1999). |

TABLE K-continued

Melanoma

| No. | Tumor-associated antigen | Reported immunogenic epitopes | Sources |
|---|---|---|---|
| 20 | MUM-3 | EAFIQPITR | Baurain et al. J. Immunol. 164(11):6057-66 (2000). |
| 21 | neo-PAP | RVIKNSIRLTL | Topalian et al. Cancer Res. 62(19):5505-9 (2002). |
| 22 | Myosin class I | KINKNPKYK | Zorn, et al. Eur. J. Immunol. 29(2):592-601 (1999). |
| 23 | PPP1R3B | YTDFHCQYV | Robbins et al. Nat Med. 19(6):747-52 (2013). Lu et al. J Immunol. 190(12):6034-42 (2013). |
| 24 | PRDX5 | LLLDDLLVSI | Sensi et al. Cancer Res. 65(2):632-40 (2005). |
| 25 | PTPRK | PYYFAAELPPRNLPEP | Novellino et al. J. Immunol. 170(12):6363-70 (2003). |
| 26 | N-ras | ILDTAGREEY | Linard et al. J. Immunol. 168(9):4802-8 (2002). |
| 27 | RBAF600 | RPHVPESAF | Lennerz et al. Proc. Natl. Acad. Sci. U.S.A. 102(44):16013-8 (2005). |
| 28 | SIRT2 | KIFSEVTLK | Lennerz et al. Proc. Natl. Acad. Sci. U.S.A. 102(44):16013-8 (2005). |
| 29 | SNRPD1 | SHETVIIEL | Lennerz et al. Proc. Natl. Acad. Sci. U.S.A. 102(44):16013-8 (2005). |
| 30 | Triosephosphate isomerase | GELIGILNAAKVPAD | Pieper et al. J Exp Med. 189(5):757-66 (1999). |
| 31 | OA1 | LYSACFWWL | Touloukian et al. J. Immunol. 170(3):1579-85 (2003). |
| 32 | RAB38/NY-MEL-1 | VLHWDPETV | Walton et al. J Immunol. 177(11):8212-8 (2006). |
| 33 | TRP-1/gp75 | MSLQRQFLR; ISPNSVFSQWRVVCDSLEDY; SLPYWNFATG; and SQWRVVCDSLEDYDT | Touloukian et al. Cancer Res. 62(18):5144-7 (2002). Robbins et al. J. Immunol. (10):6036-47 (2002). Osen et al. PLoS One. 5(11):e14137 (2010). |
| 34 | TRP-2 | SVYDFFVWL; TLDSQVMSL; LLGPGRPYR; ANDPIFVVL; QCTEVRADTRPWSGP; and ALPYWNFATG | Parkhurst et al. Cancer Res. 58(21):4895-901 (1998). Noppen et al. Int. J. Cancer. 87(2):241-6 (2000). Wang et al. J. Exp. Med. 1184(6):2207-16 (1996). Wang et al. J. Immunol. 160(2):890-7 (1998). Castelli et al. J. Immunol. 162(3):1739-48 (1999). Paschen et al. Clin. Cancer Res. (14):5241-7 (2005). Robbins et al. J. Immunol. 169(10):6036-47 (2002). |
| 35 | tyrosinase | KCDICTDEY; SSDYVIPIGTY; MLLAVLYCL; CLLWSFQTSA; YMDGTMSQV; AFLPWHRLF; IYMDGTADFSF; QCSGNFMGF; TPRLPSSADVEF; LPSSADVEF; LHHAFVDSIF; | Kittlesen et al. J. Immunol. 160(5):2099-106 (1998). Kawakami et al. J. Immunol. (12):6985-92 (1998). Wölfel et al. Eur. J. Immunol. 24(3):759-64 (1994). Riley et al. J. Immunother. 24(3):212-20 (2001). Skipper et al. J. Exp. Med. 183(2):527-34 (1996). Kang et al. J. Immunol. |

TABLE K-continued

Melanoma

| No. | Tumor-associated antigen | Reported immunogenic epitopes | Sources |
|---|---|---|---|
| | | SEIWRDIDF; QNILLSNAPLGPQFP; SYLQDSDPDSFQD; and FLLHHAFVDSIFEQWLQRHRP | 155(3):1343-8 (1995). Dalet et al. Proc. Natl. Acad. Sci. U.S.A. 108(29):E323-31 (2011) Lennerz et al. Proc. Natl. Acad. Sci. U.S.A. 102(44):16013-8 (2005). Benlalam et al. J. Immunol. 171(11):6283-9 (2003). Morel et al. Int. J. Cancer. 83(6):755-9 (1999). Brichard et al. Eur. J. Immunol. 26(1):224-30 (1996). Topalian et al. J. Exp. Med. (5):1965-71 (1996). Kobayashi et al. Cancer Res. 58(2):296-301 (1998). |
| 36 | Melan-A/MART-1 | YTTAEEAAGIGILTVILGVLLLIG CWYCRR | Meng et al. J. Immunother. 23:525-534 (2011) |
| 37 | gp100/PmeI17 | ALNFPGSQK ALNFPGSQK VYFFLPDHL RTKQLYPEW HTMEVTVYHR SSPGCQPPA VPLDCVLYRY LPHSSSHWL SNDGPTLI GRAMLGTHTMEVTVY WNRQLYPEWTEAQRLD TTEWVETTARELPIPEPE TGRAMLGTHTMEVTVYH GRAMLGTHTMEVTVY | El Hage et al. Proc. Natl. Acad. Sci. U.S.A. 105(29):10119-24 (2008). Kawashima et al. Hum Immunol. 59(1):1-14 (1998). Robbins et al. J Immunol. 159(1):303-8 (1997). Sensi et al. Tissue Antigens. 59(4):273-9 (2002). Lennerz et al. Proc Natl Acad Sci USA. 102(44):16013-8 (2005). Benlalam et al. J Immunol. 171(11):6283-9 (2003). Vigneron et al. Tissue Antigens. 65(2):156-62 (2005). Castelli et al. J Immunol. 162(3):1739-48 (1999). Touloukian et al. J Immunol. 164(7):3535-42 (2000). Parkhurst et al. J Immunother. 27(2):79-91(2004). Lapointe et al. J Immunol. 167(8):4758-64(2001). Kobayashi et al. Cancer Res. 61(12):4773-8 (2001). |
| 38 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL) SLLMWITQC MLMAQEALAFL YLAMPFATPME ASGPGGGAPR LAAQERRVPR TVSGNILTIR APRGPHGGAASGL MPFATPMEAEL KEFTVSGNILTI MPFATPMEA FATPMEAEL FATPMEAELAR LAMPFATPM ARGPESRLL SLLMWITQCFLPVF LLEFYLAMPFATPMEAELARRSLAQ EFYLAMPFATPM PGVLLKEFTVSGNILTIRLTAADHR RLLEFYLAMPFA QGAMLAAQERRVPRAAEVPR PFATPMEAELARR PGVLLKEFTVSGNILTIRLT VLLKEFTVSG AADHRQLQLSISSCLQQL | Jager et al. Proc. Natl. Acad. Scie. U.S.A. 103(39):14453-8 (2006). Gnjatic et al. PNAS Sep. 26, 2000 vol. 97 no. 20 p. 10919 Jager et al. J Exp Med. 187(2):265-70 (1998). Chen et al. J Immunol. 165(2):948-55 (2000). Valmori et al. Cancer Res. 60(16):4499-506 (2000). Aarnoudse et al. Int J Cancer. 82(3):442-8 (1999). Eikawa et al. Int J Cancer. 132(2):345-54 (2013). Wang et al. J Immunol. 161(7):3598-606 (1998). Matsuzaki et al. Cancer Immunol Immunother. 57(8)1185-95 (2008). Ebert et al. Cancer Res. 69(3):1046-54 (2009). Eikawa et al. Int J Cancer. 132(2):345-54 (2013). Knights et al. Cancer Immunol Immunother. 58(3):325-38 (2009). Jäger et al. Cancer Immun. 2:12 (2002). Zeng et al. Proc Natl Acad Sci USA. 98(7):3964-9 (2001). Mandic et al. J Immunol. 174(3):1751-9 (2005). |

TABLE K-continued

Melanoma

| No. | Tumor-associated antigen | Reported immunogenic epitopes | Sources |
|---|---|---|---|
| | | LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | Chen et al. Proc Natl Acad Sci USA. 101(25):9363-8 (2004).<br>Ayyoub et al. Clin Cancer Res. 16(18):4607-15 (2010).<br>Slager et al. J Immunol. 172(8):5095-102 (2004).<br>Mizote et al. Vaccine. 28(32):5338-46 (2010).<br>Jager et al. J Exp Med. 191(4):625-30 (2000).<br>Zarour et al. Cancer Res. 60(17):4946-52 (2000).<br>Zeng et al. J Immunol. 165(2):1153-9 (2000).<br>Bioley et al. Clin Cancer Res. 15(13):4467-74 (2009).<br>Zarour et al. Cancer Res. 62(1):213-8 (2002).<br>Hasegawa et al. Clin Cancer Res. 12(6):1921-7 (2006). |
| 39 | BAGE-1 | AARAVFLAL | Boel et al. Immunity. 2(2):167-75 (1995). |
| 40 | GAGE-1,2,8 | YRPRPRRY | Van den Eynde et al. J Exp Med. 182(3):689-98 (1995). |
| 41 | GAGE-3,4,5,6,7 (cutaneous melanoma) | YYWPRPRRY | De Backer et al. Cancer Res. 59(13):3157-65 (1999). |
| 42 | GnTVf | VLPDVFIRC(V) | Guilloux et al. J Exp Med. 183(3):1173-83 (1996). |
| 43 | HERV-K-MEL | MLAVISCAV | Schiavetti et al. Cancer Res. 62(19):5510-6 (2002). |
| 44 | KK-LC-1 | RQKRILVNL | Fukuyama et al. Cancer Res. 66(9):4922-8 (2006). |
| 45 | KM-HN-1 | NYNNFYRFL<br>EYSKECLKEF<br>EYLSLSDKI | Fukuyama et al. Cancer Res. 66(9):4922-8 (2006).<br>Monji et al. Clin Cancer Res. 10 (18 Pt 1):6047-57 (2004). |
| 46 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer. 82(3):442-8 (1999).<br>Rimoldi et al. J Immunol. 165(12):7253-61 (2000).<br>Wang et al. J Immunol. 161(7):3598-606 (1998).<br>Sun et al. Cancer Immunol Immunother. 55(6):644-52 (2006).<br>Slager et al. Cancer Gene Ther. 11(3):227-36 (2004).<br>Zeng et al. Proc Natl Acad Sci USA. 98(7):3964-9 (2001).<br>Slager et al. J Immunol. 172(8):5095-102 (2004).<br>Jager et al. J Exp Med. 191(4):625-30 (2000).<br>Slager et al. J Immunol. 170(3):1490-7 (2003).<br>Wang et al. Immunity. 20(1):107-18 (2004).<br>Hasegawa et al. Clin Cancer Res. 12(6):1921-7 (2006). |
| 47 | LY6K | RYCNLEGPPI<br>KWTEPYCVIAAVKIFPRFFMVAKQ<br>KCCKIRYCNLEGPPINSSVF | Suda et al. Cancer Sci. 98(11):1803-8 (2007).<br>Tomita et al. Oncoimmunology. 3:e28100 (2014). |

TABLE K-continued

Melanoma

| No. | Tumor-associated antigen | Reported immunogenic epitopes | Sources |
|---|---|---|---|
| 48 | MAGE-A1 | EADPTGHSY<br>KVLEYVIKV<br>SLFRAVITK<br>EVYDGREHSA<br>RVRFFFPSL<br>EADPTGHSY<br>REPVTKAEML<br>KEADPTGHSY<br>DPARYEFLW<br>ITKKVADLVGF<br>SAFPTTINF<br>SAYGEPRKL<br>RVRFFFPSL<br>TSCILESLFRAVITK<br>PRALAETSYVKVLEY<br>FLLLKYRAREPVTKAE<br>EYVIKVSARVRF | Traversari et al. J Exp Med. 176(5):1453-7 (1992).<br>Ottaviani et al. Cancer Immunol Immunother. 54(12):1214-20 (2005).<br>Pascolo et al. Cancer Res. 61(10):4072-7(2001).<br>Chaux et al. J Immunol. 163(5):2928-36 (1999).<br>Luiten et al. Tissue Antigens. 55(2):149-52 (2000).<br>Luiten et al. Tissue Antigens. 56(1):77-81 (2000).<br>Tanzarella et al. Cancer Res. 59(11):2668-74 (1999).<br>Stroobant et al. Eur J Immunol. 42(6):1417-28 (2012).<br>Corbière et al. Tissue Antigens. 63(5):453-7 (2004).<br>Goodyear et al. Cancer Immunol Immunother. 60(12):1751-61 (2011).<br>van der Bruggen et al. Eur J Immunol. 24(9):2134-40 (1994).<br>Wang et al. Cancer Immunol Immunother. 56(6):807-18 (2007).<br>Chaux et al. J Exp Med. 189(5):767-78 (1999).<br>Chaux et al. Eur J Immunol. 31(6)1910-6 (2001). |
| 49 | MAGE-A6 | MVKISGGPR<br>EVDPIGHVY<br>REPVTKAEML<br>EGDCAPEEK<br>ISGGPRISY<br>LLKYRAREPVTKAE | Zorn et al. Eur J Immunol. 29(2):602-7 (1999).<br>Benlalam et al. J Immunol. 171(11):6283-9 (2003).<br>Tanzarella et al. Cancer Res. 59(11):2668-74 (1999).<br>Breckpot et al. J Immunol. 172(4):2232-7 (2004).<br>Vantomme et al. Cancer Immun. 3:17 (2003).<br>Chaux et al. J Exp Med. 189(5):767-78 (1999). |
| 50 | MAGE-A10 | GLYDGMEHL<br>DPARYEFLW | Huang et al. J Immunol. 162(11):6849-54 (1999).<br>Chaux et al. J Immunol. 163(5):2928-36 (1999). |
| 51 | MAGE-A12 | FLWGPRALV<br>VRIGHLYIL<br>EGDCAPEEK<br>REPFTKAEMLGSVIR<br>AELVHFLLLKYRAR | van der Bruggen et al. Eur J Immunol. 24(12):3038-43 (1994).<br>Heidecker et al. J Immunol. 164(11):6041-5 (2000).<br>Panelli et al. J Immunol. 164(8):4382-92 (2000).<br>Breckpot et al. J Immunol. 172(4):2232-7 (2004).<br>Wang et al. Cancer Immunol Immunother. 56(6):807-18 (2007).<br>Chaux et al. J Exp Med. 189(5):767-78 (1999). |
| 52 | MAGE-C2 | LLFGLALIEV<br>ALKDVEERV<br>SESIKKKVL<br>ASSTLYLVF<br>SSTLYLVFSPSSFST | Ma et al. Int J Cancer. 109(5):698-702 (2004).<br>Godelaine et al. Cancer Immunol Immunother. 56(6):753-9 (2007).<br>Ma et al. Int J Cancer. 129(10):2427-34 (2011).<br>Wen et al. Cancer Sci. 102(8):1455-61 (2011). |
| 53 | NA88-A | QGQHFLQKV | Moreau-Aubry et al. J Exp Med. 191(9):1617-24 (2000). |

TABLE K-continued

Melanoma

| No. | Tumor-associated antigen | Reported immunogenic epitopes | Sources |
|---|---|---|---|
| 54 | Sp17 | ILDSSEEDK | Chiriva-Internati et al. Int J Cancer. 107(5):863-5 (2003). |
| 55 | SSX-2 | KASEKIFYV<br>EKIQKAFDDIAKYFSK<br>FGRLQGISPKI<br>WEKMKASEKIFYVYMKRK<br>KIFYVYMKRKYEAMT<br>KIFYVYMKRKYEAM | Ayyoub et al. J Immunol. 168(4):1717-22 (2002).<br>Ayyoub et al. J Immunol. 172(11):7206-11 (2004).<br>Neumann et al. Cancer Immunol Immunother. 60(9):1333-46 (2011).<br>Ayyoub et al. Clin Immunol. 114(1):70-8 (2005).<br>Neumann et al. Int J Cancer. 112(4):661-8 (2004).<br>Ayyoub et al. J Clin Invest. 113(8):1225-33 (2004). |
| 56 | SSX-4 | INKTSGPKRGKHAWTHRLRE<br>YFSKKEWEKMKSSEKIVYVY<br>MKLNYEVMTKLGFKVTLPPF<br>KHAWTHRLRERKQLVVYEEI<br>LGFKVTLPPFMRSKRAADFH<br>KSSEKIVYVYMKLNYEVMTK<br>KHAWTHRLRERKQLVVYEEI | Ayyoub et al. J Immunol. 174(8):5092-9 (2005).<br>Valmori et al. Clin Cancer Res. 12(2):398-404 (2006). |
| 57 | TRAG-3 | CEFHACWPAFTVLGE | Janjic et al. J Immunol. 177(4):2717-27 (2006). |
| 58 | TRP2-INT2g | EVISCKLIKR | Lupetti et al. J Exp Med. 188(6):1005-16 (1998). |
| 59 | pgk | | Morgan et al., J. Immunol. 171:3287-3295 (2003) |

TABLE L

Squamous cell carcinoma

| No. | Tumor-associated antigen | Reported immunogenic epitopes | Sources |
|---|---|---|---|
| 1 | CASP-8 | FPSDSWCYF | Mandruzzato et al. J. Exp. Med. 186(5):785-93 (1997). |
| 2 | p53 | VVPCEPPEV | Ito et al. Int. J. Cancer. 120(12):2618-24(2007). |
| 3 | SAGE | LYATVIHDI | Miyahara et al. Clin Cancer Res. 11(15):5581-9 (2005). |

TABLE M

Chronic myeloid leukemia

| No. | Tumor-associated antigen | Reported immunogenic epitopes | Sources |
|---|---|---|---|
| 1 | BCR-ABL | SSKALQRPV;<br>GFKQSSKAL;<br>ATGFKQSSKAL<br>QRPVAS;<br>and | Yotnda et al. J. Clin. Invest. 101(10):2290-6 (1998).<br>Bosch et al. |

TABLE M-continued

Chronic myeloid leukemia

| No. | Tumor-associated antigen | Reported immunogenic epitopes | Sources |
|---|---|---|---|
| | | ATGFKQSSKAL<br>QRPVAS | Blood. 88(9):3522-7 (1996).<br>Makita et al. Leukemia. 16(12):2400-7 (2002). |
| 2 | dek-can | TMKQICKKEIR<br>RLHQY | Makita et al. Leukemia. 16(12):2400-7 (2002). |
| 3 | EFTUD2 | KILDAVVAQK | Lennerz et al. Proc. Natl. Acad. Sci. U.S.A. 102(44):16013-8 (2005). |
| 4 | GAGE-3,4,5,6,7 | YYVVPRPRRY | De Backer et al. Cancer Res. 59(13):3157-65 (1999). |

TABLE N

Acute lymphoblastic leukemia

| No. | Tumor-associated antigen | Reported immunogenic epitopes | Sources |
|---|---|---|---|
| 1 | ETV6-AML1 | RIAECILGM and IGRIAECILGM NPSR | Yotnda et al. J. Clin. Invest. (2):455-62 (1998). Yun et al. Tissue Antigens. 54(2):153-61 (1999). |
| 2 | GAGE-3,4,5,6,7 | YYWPRPRRY | De Backer et al. Cancer Res. 59(13): 3157-65 (1999). |

TABLE O

Acute myelogenous leukemia

| No. | Tumor-associated antigen | Reported immunogenic epitopes | Sources |
|---|---|---|---|
| 1 | FLT3-ITD | YVDFREYEYY | Graf et al. Blood. 109(7):2985-8 (2007). |
| 2 | Cyclin-A1 | FLDRFLSCM and SLIAAAAFCLA | Ochsenreither et al. Blood. 119(23): 5492-501 (2012). |
| 3 | GAGE-3,4,5,6,7 | YYWPRPRRY | De Backer et al. Cancer Res. 59(13): 3157-65 (1999). |

TABLE P

Chronic lymphocytic leukemia

| No. | Tumor-associated antigen | Reported immunogenic epitopes | Sources |
|---|---|---|---|
| 1 | FNDC3B | VVMSWAPPV | Rajasagi et al. Blood. 124(3):453-62 (2014). |
| 2 | GAGE-3,4,5,6,7 | YYWPRPRRY | De Backer et al. Cancer Res. 59(13): 3157-65 (1999). |

TABLE Q

Promyelocytic leukemia

| No. | Tumor-associated antigen | Reported immunogenic epitopes | Sources |
|---|---|---|---|
| 1 | pml-RARalpha | NSNHVASGAGE AAIETQSSSSE EIV | Gambacorti-Passerini et al. Blood. 81(5): 1369-75 (1993). |
| 2 | GAGE-3,4,5,6,7 | YYWPRPRRY | De Backer et al. Cancer Res. 59(13): 3157-65 (1999). |

TABLE R

Multiple myeloma

| No. | Tumor-associated antigen | Reported immunogenic epitopes | Sources |
|---|---|---|---|
| 1 | MAGE-C1 | ILFGISLREV KVVEFLAML SSALLSIFQSSPE SFSYTLLSL VSSFFSYTL | Anderson et al. Cancer Immunol Immunother. 60(7):985-97 (2011). Nuber et al. Proc Natl Acad Sci USA. 107(34):15187-92 (2010). |
| 2 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL) SLLMWITQC MLMAQEALAFL YLAMPFATPME ASGPGGGAPR LAAQERRVPR TVSGNILTIR APRGPHGGAASGL MPFATPMEAEL KEFTVSGNILTI MPFATPMEA FATPMEAEL FATPMEAELAR LAMPFATPM ARGPESRLL SLLMWITQCFLPVF LLEFYLAMPFATPMEAELARRSLAQ | Jager et al. Proc. Natl. Scie. U.S.A. 103(39):14453-8 (2006). Gnjatic et al. PNAS Sep. 26, 2000 vol. 97 no. 20 p. 10919 Jager et al. J Exp Med. 187(2):265-70 (1998). Chen et al. J Immunol. 165(2):948-55 (2000). Valmori et al. Cancer Res. 60(16):4499-506 (2000). Aarnoudse et al. Int J Cancer. 82(3):442-8 (1999). Eikawa et al. Int J Cancer. 132(2):345-54 (2013). Wang et al. J Immunol. 161(7):3598-606 (1998). Matsuzaki et al. Cancer Immunol Immunother. 57(8)1185-95 (2008). Ebert et al. Cancer Res. 69(3)1046-54 (2009). Eikawa et al. Int J Cancer. 132(2):345-54 (2013). |

TABLE R-continued

Multiple myeloma

| No. | Tumor-associated antigen | Reported immunogenic epitopes | Sources |
|---|---|---|---|
| | | EFYLAMPFATPM<br>PGVLLKEFTVSGNILTIRLTAADHR<br>RLLEFYLAMPFA<br>QGAMLAAQERRVPRAAEVPR<br>PFATPMEAELARR<br>PGVLLKEFTVSGNILTIRLT<br>VLLKEFTVSG<br>AADHRQLQLSISSCLQQL<br>LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | Knights et al. Cancer Immunol Immunother. 58(3):325-38 (2009).<br>Jäger et al. Cancer Immun. 2:12 (2002).<br>Zeng et al. Proc Natl Acad Sci USA. 98(7):3964-9 (2001).<br>Mandic et al. J Immunol. 174(3):1751-9 (2005).<br>Chen et al. Proc Natl Acad Sci USA. 101(25):9363-8 (2004).<br>Ayyoub et al. Clin Cancer Res. 16(18):4607-15 (2010).<br>Slager et al. J Immunol. 172(8):5095-102 (2004).<br>Mizote et al. Vaccine. 28(32):5338-46 (2010).<br>Jager et al. J Exp Med. 191(4):625-30 (2000).<br>Zarour et al. Cancer Res. 60(17):4946-52 (2000).<br>Zeng et al. J Immunol. 165(2):1153-9 (2000).<br>Bioley et al. Clin Cancer Res. 15(13):4467-74 (2009).<br>Zarour et al. Cancer Res. 62(1):213-8 (2002).<br>Hasegawa et al. Clin Cancer Res. 12(6):1921-7 (2006). |
| 3 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer. 82(3):442-8 (1999).<br>Rimoldi et al. J Immunol. 165(12):7253-61 (2000).<br>Wang et al. J Immunol. 161(7):3598-606 (1998).<br>Sun et al. Cancer Immunol Immunother. 55(6):644-52 (2006).<br>Slager et al. Cancer Gene Ther. 11(3):227-36 (2004).<br>Zeng et al. Proc Natl Acad Sci USA. 98(7):3964-9 (2001).<br>Slager et al. J Immunol. 172(8):5095-102 (2004).<br>Jager et al. J Exp Med. 191(4):625-30 (2000).<br>Slager et al. J Immunol. 170(3):1490-7 (2003).<br>Wang et al. Immunity. 20(1):107-18 (2004).<br>Hasegawa et al. Clin Cancer Res. 12(6):1921-7 (2006). |
| 4 | HERV-K-MEL | MLAVISCAV | Schiavetti et al. Cancer Res. 62(19):5510-6 (2002). |
| 5 | KK-LC-1 | RQKRILVNL | Fukuyama et al. Cancer Res. 66(9):4922-8 (2006). |
| 6 | KM-HN-1 | NYNNFYRFL<br>EYSKECLKEF<br>EYLSLSDKI | Fukuyama et al. Cancer Res. 66(9):4922-8 (2006).<br>Monji et al. Clin Cancer Res. 10(18 Pt 1):6047-57 (2004). |
| 7 | Sp17 | ILDSSEEDK | Chiriva-Internati et al. Int J Cancer. 107(5):863-5 (2003). |

TABLE S

B-cell lymphoma

| No. | Tumor-associated antigen | Reported immunogenic epitopes | Source |
|---|---|---|---|
| 1 | D393-CD20 | KPLFRRMSSLELVIA | Vauchy et al. Int J Cancer. 137(1): 116-26 (2015). |

TABLE T

Bladder carcinoma

| No. | Tumor-associated antigen | Reported immunogenic epitopes | Sources |
|---|---|---|---|
| 1 | BAGE-1 | AARAVFLAL | Boel et al. Immunity. 2(2): 167-75 (1995). |
| 2 | GAGE-1,2,8 | YRPRPRRY | Van den Eynde et al. J Exp Med. 182(3):689-98 (1995). |
| 3 | GAGE-3,4,5,6,7 | YYWPRPRRY | De Backer et al. Cancer Res. 59(13):3157-65 (1999). |
| 4 | MAGE-A4 (transitional cell carcinoma of urinary bladder) | EVDPASNTY<br>GVYDGREHTV<br>NYKRCFPVI<br>SESLKMIF | Kobayashi et al. Tissue Antigens. 62(5):426-32 (2003).<br>Duffour et al. Eur J Immunol. 29(10):3329-37 (1999).<br>Miyahara et al. Clin Cancer Res. 11(15):5581-9 (2005).<br>Ottaviani et al. Cancer Immunol Immunother. 55(7):867-72 (2006).<br>Zhang et al. Tissue Antigens. 60(5): 365-71(2002). |
| 5 | MAGE-A6 | MVKISGGPR<br>EVDPIGHVY<br>REPVTKAEML<br>EGDCAPEEK<br>ISGGPRISY<br>LLKYRAREPVTKAE | Zorn et al. Eur J Immunol. 29(2): 602-7 (1999).<br>Benlalam et al. J Immunol. 171(11):6283-9 (2003).<br>Tanzarella et al. Cancer Res. 59(11):2668-74 (1999).<br>Breckpot et al. J Immunol. 172(4): 2232-7 (2004).<br>Vantomme et al. Cancer Immun. 3:17 (2003).<br>Chaux et al. J Exp Med. 189(5):767-78 (1999). |
| 6 | SAGE | LYATVIHDI | Miyahara et al. Clin Cancer Res. 11(15):5581-9 (2005). |
| 7 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL)<br>SLLMWITQC<br>MLMAQEALAFL<br>YLAMPFATPME<br>ASGPGGGAPR<br>LAAQERRVPR<br>TVSGNILTIR<br>APRGPHGGAASGL<br>MPFATPMEAEL<br>KEFTVSGNILTI<br>MPFATPMEA<br>FATPMEAEL<br>FATPMEAELAR<br>LAMPFATPM<br>ARGPESRLL<br>SLLMWITQCFLPVF<br>LLEFYLAMPFATPMEAELARRSLAQ | Jager et al. Proc. Natl. Acad. Scie. U.S.A. 103(39):14453-8 (2006).<br>Gnjatic et al. PNAS Sep. 26, 2000 vol. 97 no. 20 p. 10919<br>Jager et al. J Exp Med. 187(2):265-70 (1998).<br>Chen et al. J Immunol. 165(2):948-55 (2000).<br>Valmori et al. Cancer Res. 60(16):4499-506 (2000).<br>Aarnoudse et al. Int J Cancer. 82(3):442-8 (1999).<br>Eikawa et al. Int J Cancer. 132(2):345-54 (2013).<br>Wang et al. J Immunol. 161(7):3598-606 (1998).<br>Matsuzaki et al. Cancer Immunol Immunother. 57(8)1185-95 (2008).<br>Ebert et al. Cancer Res. 69(3)1046-54 (2009).<br>Eikawa et al. Int J Cancer. 132(2):345-54 (2013). |

TABLE T-continued

Bladder carcinoma

| No. | Tumor-associated antigen | Reported immunogenic epitopes | Sources |
|---|---|---|---|
| | | EFYLAMPFATPM<br>PGVLLKEFTVSGNILTIRLTAADHR<br>RLLEFYLAMPFA<br>QGAMLAAQERRVPRAAEVPR<br>PFATPMEAELARR<br>PGVLLKEFTVSGNILTIRLT<br>VLLKEFTVSG<br>AADHRQLQLSISSCLQQL<br>LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | Knights et al. Cancer Immunol Immunother. 58(3):325-38 (2009).<br>Jäger et al. Cancer Immun. 2:12 (2002).<br>Zeng et al. Proc Natl Acad Sci USA. 98(7):3964-9 (2001).<br>Mandic et al. J Immunol. 174(3):1751-9 (2005).<br>Chen et al. Proc Natl Acad Sci USA. 101(25):9363-8 (2004).<br>Ayyoub et al. Clin Cancer Res. 16(18):4607-15 (2010).<br>Slager et al. J Immunol. 172(8):5095-102 (2004).<br>Mizote et al. Vaccine. 28(32):5338-46 (2010).<br>Jager et al. J Exp Med. 191(4):625-30 (2000).<br>Zarour et al. Cancer Res. 60(17):4946-52 (2000).<br>Zeng et al. J Immunol. 165(2):1153-9 (2000).<br>Bioley et al. Clin Cancer Res. 15(13):4467-74 (2009).<br>Zarour et al. Cancer Res. 62(1):213-8 (2002).<br>Hasegawa et al. Clin Cancer Res. 12(6):1921-7 (2006). |
| 8 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer. 82(3):442-8 (1999).<br>Rimoldi et al. J Immunol. 165(12):7253-61 (2000).<br>Wang et al. J Immunol. 161(7):3598-606 (1998).<br>Sun et al. Cancer Immunol Immunother. 55(6):644-52 (2006).<br>Slager et al. Cancer Gene Ther. 11(3):227-36 (2004).<br>Zeng et al. Proc Natl Acad Sci USA. 98(7):3964-9 (2001).<br>Slager et al. J Immunol. 172(8):5095-102 (2004).<br>Jager et al. J Exp Med. 191(4):625-30 (2000).<br>Slager et al. J Immunol. 170(3):1490-7 (2003).<br>Wang et al. Immunity. 20(1):107-18 (2004).<br>Hasegawa et al. Clin Cancer Res. 12(6):1921-7 (2006). |
| 9 | HERV-K-MEL | MLAVISCAV | Schiavetti et al. Cancer Res. 62(19):5510-6 (2002). |
| 10 | KK-LC-1 | RQKRILVNL | Fukuyama et al. Cancer Res. 66(9):4922-8 (2006). |
| 11 | KM-HN-1 | NYNNFYRFL<br>EYSKECLKEF<br>EYLSLSDKI | Fukuyama et al. Cancer Res. 66(9):4922-8 (2006).<br>Monji et al. Clin Cancer Res. 10(18 Pt 1):6047-57 (2004). |
| 12 | Sp17 | ILDSSEEDK | Chiriva-Internati et al. Int J Cancer. 107(5):863-5 (2003). |

TABLE U

Head and neck cancer

| No. | Tumor-associated antigen | Reported immunogenic epitopes | Sources |
|---|---|---|---|
| 1 | BAGE-1 (head and neck squamous cell carcinoma) | AARAVFLAL | Boel et al. Immunity. 2(2): 167-75 (1995). |
| 2 | GAGE-1,2,8 | YRPRPRRY | Van den Eynde et al. J Exp Med. 182(3):689-98 (1995). |
| 3 | GAGE-3,4,5,6,7 | YYWPRPRRY | De Backer et al. Cancer Res. 59(13):3157-65 (1999). |
| 4 | LY6K | RYCNLEGPPI<br>KWTEPYCVIAAVKIFPRFFMVAKQ<br>KCCKIRYCNLEGPPINSSVF | Suda et al. Cancer Sci. 98(11):1803-8 (2007).<br>Tomita et al. Oncoimmunology. 3:e28100 (2014). |
| 5 | MAGE-A3 (head and neck squamous cell carcinoma) | EVDPIGHLY<br>FLWGPRALV<br>KVAELVHFL<br>TFPDLESEF<br>VAELVHFLL<br>MEVDPIGHLY<br>EVDPIGHLY<br>REPVTKAEML<br>AELVHFLLL<br>MEVDPIGHLY<br>WQYFFPVIF<br>EGDCAPEEK<br>KKLLTQHFVQENYLEY<br>RKVAELVHFLLLKYR<br>KKLLTQHFVQENYLEY<br>ACYEFLWGPRALVETS<br>RKVAELVHFLLLKYR<br>VIFSKASSSLQL<br>VFGIELMEVDPIGHL<br>GDNQIMPKAGLLIIV<br>TSYVKVLHHMVKISG<br>RKVAELVHFLLLKYRA<br>FLLLKYRAREPVTKAE | Gaugler et al. J Exp Med. 179(3): 921-30 (1994).<br>van der Bruggen et al. Eur J Immunol. 24(12):3038-43 (1994).<br>Kawashima et al. Hum Immunol. 59(1):1-14 (1998).<br>Oiso et al. Int J Cancer. 81(3):387-94 (1999).<br>Miyagawa et al. Oncology. 70(1):54-62 (2006).<br>Bilsborough et al. Tissue Antigens. 60(1):16-24 (2002).<br>Schultz et al. Tissue Antigens. 57(2):103-9 (2001).<br>Tanzarella et al. Cancer Res. 59(11):2668-74 (1999).<br>Schultz et al. J Exp Med. 195(4):391-9 (2002).<br>Herman et al. Immunogenetics. 43(6):377-83 (1996).<br>Russo et al. Proc Natl Aced Sci USA. 97(5):2185-90 (2000).<br>Breckpot et al. J Immunol. 172(4): 2232-7 (2004).<br>Schultz et al. Cancer Res. 60(22): 6272-5 (2000).<br>Cesson et al. Cancer Immunol Immunother. 60(1):23-35 (2011).<br>Schultz et al. J Immunol. 172(2): 1304-10 (2004).<br>Zhang et al. J Immunol. 171(1): 219-25 (2003).<br>Cesson et al. Cancer Immunol Immunother. 60(1):23-35 (2010).<br>Kobayashi et al. Cancer Res. 61(12):4773-8 (2001).<br>Cesson et al. Cancer Immunol Immunother. 60(1):23-35 (2011).<br>Consogno et al. Blood. 101(3):1038-44 (2003).<br>Manici et al. J Exp Med. 189(5):871-6 (1999).<br>Chaux et al. J Exp Med. 189(5):767-78 (1999). |
| 6 | MAGE-A6 | MVKISGGPR<br>EVDPIGHVY<br>REPVTKAEML<br>EGDCAPEEK<br>ISGGPRISY<br>LLKYRAREPVTKAE | Zorn et al. Eur J Immunol. 29(2):602-7 (1999).<br>Benlalam et al. J Immunol. 171(11):6283-9 (2003).<br>Tanzarella et al. Cancer Res. 59(11):2668-74 (1999).<br>Breckpot et al. J Immunol. 172(4): 2232-7 (2004). |

TABLE U-continued

Head and neck cancer

| No. | Tumor-associated antigen | Reported immunogenic epitopes | Sources |
|---|---|---|---|
| | | | Vantomme et al. Cancer Immun. 3:17 (2003). |
| | | | Chaux et al. J Exp Med. 189(5): 767-78 (1999). |
| 7 | SAGE | LYATVIHDI | Miyahara et al. Clin Cancer Res. 11(15):5581-9 (2005). |

TABLE V

Esophageal cancer

| No. | Tumor-associated antigen | Reported immunogenic epitopes | Sources |
|---|---|---|---|
| 1 | GAGE-3,4,5,6,7 (Esophageal squamous cell carcinoma and esophageal adenocarcinoma) | YYWPRPRRY | De Backer et al. Cancer Res. 59(13):3157-65 (1999). |
| 2 | MAGE-A2 | YLQLVFGIEV<br>EYLQLVFGI<br>REPVTKAEML<br>EGDCAPEEK<br>LLKYRAREPVTKAE | Kawashima et al. Hum Immunol. 59(1):1-14 (1998).<br>Tahara et al. Clin Cancer Res. 5(8):2236-41 (1999).<br>Tanzarella et al. Cancer Res. 59(11):2668-74 (1999).<br>Breckpot et al. J Immunol. 172(4): 2232-7 (2004).<br>Chaux et al. J Exp Med. 189(5):767-78 (1999). |
| 3 | MAGE-A6 | MVKISGGPR<br>EVDPIGHVY<br>REPVTKAEML<br>EGDCAPEEK<br>ISGGPRISY<br>LLKYRAREPVTKAE | Zorn et al. Eur J Immunol. 29(2):602-7 (1999).<br>Benlalam et al. J Immunol. 171(11):6283-9 (2003).<br>Tanzarella et al. Cancer Res. 59(11):2668-74 (1999).<br>Breckpot et al. J Immunol. 172(4): 2232-7 (2004).<br>Vantomme et al. Cancer Immun. 3:17 (2003).<br>Chaux et al. J Exp Med. 189(5): 767-78 (1999). |
| 4 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL)<br>SLLMWITQC<br>MLMAQEALAFL<br>YLAMPFATPME<br>ASGPGGGAPR<br>LAAQERRVPR<br>TVSGNILTIR<br>APRGPHGGAASGL<br>MPFATPMEAEL<br>KEFTVSGNILTI<br>MPFATPMEA<br>FATPMEAEL<br>FATPMEAELAR<br>LAMPFATPM<br>ARGPESRLL<br>SLLMWITQCFLPVF<br>LLEFYLAMPFATPMEAELARRSLAQ<br>EFYLAMPFATPM<br>PGVLLKEFTVSGNILTIRLTAADHR | Jager et al. Proc. Natl. Acad. Scie. U.S.A. 103(39):14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3):442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3) 1046-54 (2009).<br>Eikawa et al. Int J Cancer. 132(2): 345-54 (2013).<br>Knights et al. Cancer Immunol Immunother. 58(3):325-38 (2009). |

TABLE V-continued

Esophageal cancer

| No. | Tumor-associated antigen | Reported immunogenic epitopes | Sources |
|---|---|---|---|
| | | RLLEFYLAMPFA<br>QGAMLAAQERRVPRAAEVPR<br>PFATPMEAELARR<br>PGVLLKEFTVSGNILTIRLT<br>VLLKEFTVSG<br>AADHRQLQLSISSCLQQL<br>LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | Jäger et al. Cancer Immun. 2:12 (2002).<br>Zeng et al. Proc Natl Acad Sci USA.<br>98(7):3964-9 (2001).<br>Mandic et al. J Immunol. 174(3):<br>1751-9 (2005).<br>Chen et al. Proc Natl Acad Sci USA.<br>101(25):9363-8 (2004).<br>Ayyoub et al. Clin Cancer Res.<br>16(18):4607-15 (2010).<br>Slager et al. J Immunol. 172(8):<br>5095-102 (2004).<br>Mizote et al. Vaccine. 28(32):<br>5338-46 (2010).<br>Jager et al. J Exp Med. 191(4):<br>625-30 (2000).<br>Zarour et al. Cancer Res. 60(17):<br>4946-52 (2000).<br>Zeng et al. J Immunol. 165(2):<br>1153-9 (2000).<br>Bioley et al. Clin Cancer Res.<br>15(13):4467-74 (2009).<br>Zarour et al. Cancer Res. 62(1):213-8<br>(2002).<br>Hasegawa et al. Clin Cancer Res.<br>12(6):1921-7 (2006). |
| 5 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer.<br>82(3):442-8 (1999).<br>Rimoldi et al. J Immunol. 165(12):<br>7253-61 (2000).<br>Wang et al. J Immunol. 161(7):3598-606<br>(1998).<br>Sun et al. Cancer Immunol Immunother.<br>55(6):644-52 (2006).<br>Slager et al. Cancer Gene Ther.<br>11(3):227-36 (2004).<br>Zeng et al. Proc Natl Acad Sci USA.<br>98(7):3964-9 (2001).<br>Slager et al. J Immunol. 172(8):<br>5095-102 (2004).<br>Jager et al. J Exp Med. 191(4):<br>625-30 (2000).<br>Slager et al. J Immunol. 170(3):<br>1490-7 (2003).<br>Wang et al. Immunity. 20(1):107-18<br>(2004).<br>Hasegawa et al. Clin Cancer Res.<br>12(6):1921-7 (2006). |
| 6 | HERV-K-MEL | MLAVISCAV | Schiavetti et al. Cancer Res.<br>62(19):5510-6 (2002). |
| 7 | KK-LC-1 | RQKRILVNL | Fukuyama et al. Cancer Res.<br>66(9):4922-8 (2006). |
| 8 | KM-HN-1 | NYNNFYRFL<br>EYSKECLKEF<br>EYLSLSDKI | Fukuyama et al. Cancer Res.<br>66(9):4922-8 (2006).<br>Monji et al. Clin Cancer Res. 10<br>(18 Pt 1):6047-57 (2004). |
| 9 | Sp17 | ILDSSEEDK | Chiriva-Internati et al. Int J Cancer.<br>107(5):863-5 (2003). |

TABLE W

Brain cancer

| No. | Tumor-associated antigen | Reported immunogenic epitopes | Sources |
|---|---|---|---|
| 1 | TAG-1 | SLGWLFLLL<br>LSRLSNRLL | Adair et al. J Immunother. 31(1):7-17 (2008). |
| 2 | TAG-2 | LSRLSNRLL | Adair et al. J Immunother. 31(1):7-17 (2008). |

TABLE X

Pharynx cancer

| No. | Tumor-associated antigen | Reported immunogenic epitopes | Sources |
|---|---|---|---|
| 1 | TAG-1 | SLGWLFLLL<br>LSRLSNRLL | Adair et al. J Immunother. 31(1):7-17 (2008). |
| 2 | TAG-2 | LSRLSNRLL | Adair et al. J Immunother. 31(1):7-17 (2008). |

TABLE Y

Tumors of the tongue

| No. | Tumor-associated antigen | Reported immunogenic epitopes | Sources |
|---|---|---|---|
| 1 | TAG-1 | SLGWLFLLL<br>LSRLSNRLL | Adair et al. J Immunother. 31(1):7-17 (2008). |
| 2 | TAG-2 | LSRLSNRLL | Adair et al. J Immunother. 31(1):7-17 (2008). |

TABLE Z

Synovial cell sarcoma

| No. | Tumor-associated antigen | Reported immunogenic epitopes | Sources |
|---|---|---|---|
| 1 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL)<br>SLLMWITQC<br>MLMAQEALAFL<br>YLAMPFATPME<br>ASGPGGGAPR<br>LAAQERRVPR<br>TVSGNILTIR<br>APRGPHGGAASGL<br>MPFATPMEAEL<br>KEFTVSGNILTI<br>MPFATPMEA<br>FATPMEAEL<br>FATPMEAELAR<br>LAMPFATPM<br>ARGPESRLL<br>SLLMWITQCFLPVF<br>LLEFYLAMPFATPMEAELARRSLAQ<br>EFYLAMPFATPM<br>PGVLLKEFTVSGNILTIRLTAADHR<br>RLLEFYLAMPFA<br>QGAMLAAQERRVPRAAEVPR<br>PFATPMEAELARR<br>PGVLLKEFTVSGNILTIRLT<br>VLLKEFTVSG<br>AADHRQLQLSISSCLQQL<br>LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | Jager et al. Proc. Natl. Acad. Scie. U.S.A. 103(39):14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3):442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3):325-38 (2009).<br>Jäger et al. Cancer Immun. 2:12 (2002).<br>Zeng et al. Proc Natl Acad Sci USA. 98(7):3964-9 (2001).<br>Mandic et al. J Immunol. 174(3): 1751-9 (2005).<br>Chen et al. Proc Natl Acad Sci USA. 101(25):9363-8 (2004).<br>Ayyoub et al. Clin Cancer Res. 16(18):4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000). |

TABLE Z-continued

| | | Synovial cell sarcoma | |
|---|---|---|---|
| No. | Tumor-associated antigen | Reported immunogenic epitopes | Sources |
| | | | Zarour et al. Cancer Res. 60(17): 4946-52 (2000). Zeng et al. J Immunol. 165(2): 1153-9 (2000). Bioley et al. Clin Cancer Res. 15(13):4467-74 (2009). Zarour et al. Cancer Res. 62(1):213-8 (2002). Hasegawa et al. Clin Cancer Res. 12(6):1921-7 (2006). |
| 2 | LAGE-1 | MLMAQEALAFL SLLMWITQC LAAQERRVPR ELVRRILSR APRGVRMAV SLLMWITQCFLPVF QGAMLAAQERRVPRAAEVPR AADHRQLQLSISSCLQQL CLSRRPWKRSWSAGSCPGMPHL ILSRDAAPLPRPG AGATGGRGPRGAGA | Aarnoudse et al. Int J Cancer. 82(3):442-8 (1999). Rimoldi et al. J Immunol. 165(12): 7253-61 (2000). Wang et al. J Immunol. 161(7): 3598-606 (1998). Sun et al. Cancer Immunol Immunother. 55(6):644-52 (2006). Slager et al. Cancer Gene Ther. 11(3):227-36 (2004). Zeng et al. Proc Natl Acad Sci USA. 98(7):3964-9 (2001). Slager et al. J Immunol. 172(8): 5095-102 (2004). Jager et al. J Exp Med. 191(4): 625-30 (2000). Slager et al. J Immunol. 170(3): 1490-7 (2003). Wang et al. Immunity. 20(1):107-18 (2004). Hasegawa et al. Clin Cancer Res. 12(6):1921-7 (2006). |
| 3 | HERV-K-MEL | MLAVISCAV | Schiavetti et al. Cancer Res. 62(19):5510-6 (2002). |
| 4 | KK-LC-1 | RQKRILVNL | Fukuyama et al. Cancer Res. 66(9):4922-8 (2006). |
| 5 | KM-HN-1 | NYNNFYRFL EYSKECLKEF EYLSLSDKI | Fukuyama et al. Cancer Res. 66(9):4922-8 (2006). |
| 6 | Sp17 | ILDSSEEDK | Chiriva-Internati et al. Int J Cancer. 107(5):863-5 (2003). |

TABLE AA

| | | Neuroblastoma | |
|---|---|---|---|
| No. | Tumor-associated antigen | Reported immunogenic epitopes | Sources |
| 1 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL) SLLMWITQC MLMAQEALAFL YLAMPFATPME ASGPGGGAPR LAAQERRVPR TVSGNILTIR APRGPHGGAASGL MPFATPMEAEL KEFTVSGNILTI MPFATPMEA | Jager et al. Proc. Natl. Acad. Scie. U.S.A. 103(39):14453-8 (2006). Gnjatic et al. PNAS Sep. 26, 2000 vol. 97 no. 20 p. 10919 Jager et al. J Exp Med. 187(2): 265-70 (1998). Chen et al. J Immunol. 165(2): 948-55 (2000). Valmori et al. Cancer Res. 60(16): 4499-506 (2000). Aarnoudse et al. Int J Cancer. 82(3):442-8 (1999). Eikawa et al. Int J Cancer. 132(2): 345-54 (2013). Wang et al. J Immunol. 161(7): |

TABLE AA-continued

| Neuroblastoma | | | |
|---|---|---|---|
| No. | Tumor-associated antigen | Reported immunogenic epitopes | Sources |
| | | FATPMEAEL<br>FATPMEAELAR<br>LAMPFATPM<br>ARGPESRLL<br>SLLMWITQCFLPVF<br>LLEFYLAMPFATPMEAELARRSLAQ<br>EFYLAMPFATPM<br>PGVLLKEFTVSGNILTIRLTAADHR<br>RLLEFYLAMPFA<br>QGAMLAAQERRVPRAAEVPR<br>PFATPMEAELARR<br>PGVLLKEFTVSGNILTIRLT<br>VLLKEFTVSG<br>AADHRQLQLSISSCLQQL<br>LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | 3598-606 (1998).<br>Matsuzaki et al. Cancer Immunol<br>Immunother. 57(8)1185-95 (2008).<br>Ebert et al. Cancer Res. 69(3):<br>1046-54 (2009).<br>Eikawa et al. Int J Cancer. 132(2):<br>345-54 (2013).<br>Knights et al. Cancer Immunol<br>Immunother. 58(3):325-38 (2009).<br>Jäger et al. Cancer Immun. 2:12 (2002).<br>Zeng et al. Proc Natl Acad Sci USA.<br>98(7):3964-9 (2001).<br>Mandic et al. J Immunol. 174(3):<br>1751-9 (2005).<br>Chen et al. Proc Natl Acad Sci USA.<br>101(25):9363-8 (2004).<br>Ayyoub et al. Clin Cancer Res.<br>16(18):4607-15 (2010).<br>Slager et al. J Immunol. 172(8):<br>5095-102 (2004).<br>Mizote et al. Vaccine. 28(32):<br>5338-46 (2010).<br>Jager et al. J Exp Med. 191(4):<br>625-30 (2000).<br>Zarour et al. Cancer Res. 60(17):<br>4946-52 (2000).<br>Zeng et al. J Immunol. 165(2):<br>1153-9 (2000).<br>Bioley et al. Clin Cancer Res.<br>15(13):4467-74 (2009).<br>Zarour et al. Cancer Res. 62(1):213-8<br>(2002).<br>Hasegawa et al. Clin Cancer Res.<br>12(6):1921-7 (2006). |
| 2 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer.<br>82(3):442-8 (1999).<br>Rimoldi et al. J Immunol. 165(12):<br>7253-61 (2000).<br>Wang et al. J Immunol. 161(7):3598-606<br>(1998).<br>Sun et al. Cancer Immunol Immunother.<br>55(6):644-52 (2006).<br>Slager et al. Cancer Gene Ther.<br>11(3):227-36 (2004).<br>Zeng et al. Proc Natl Acad Sci USA.<br>98(7):3964-9 (2001).<br>Slager et al. J Immunol. 172(8):<br>5095-102 (2004).<br>Jager et al. J Exp Med. 191(4):<br>625-30 (2000).<br>Slager et al. J Immunol. 170(3):<br>1490-7 (2003).<br>Wang et al. Immunity. 20(1):107-18<br>(2004).<br>Hasegawa et al. Clin Cancer Res.<br>12(6):1921-7 (2006). |
| 3 | HERV-K-MEL | MLAVISCAV | Schiavetti et al. Cancer Res.<br>62(19):5510-6 (2002). |
| 4 | KK-LC-1 | RQKRILVNL | Fukuyama et al. Cancer Res.<br>66(9):4922-8 (2006). |
| 5 | KM-HN-1 | NYNNFYRFL<br>EYSKECLKEF<br>EYLSLSDKI | Fukuyama et al. Cancer Res.<br>66(9):4922-8 (2006).<br>Monji et al. Clin Cancer Res. 10<br>(18 Pt 1):6047-57 (2004). |
| 6 | Sp17 | ILDSSEEDK | Chiriva-Internati et al. Int J Cancer.<br>107(5):863-5 (2003). |

TABLE BB

Uterine cancer

| No. | Tumor-associated antigen | Reported immunogenic epitopes | Sources |
|---|---|---|---|
| 1 | NY-ESO-1 | HLA-A2-restricted peptide p157-165 (SLLMWITQC), HLA-Cw3-restricted p92-100 (LAMP-FATPM) and HLA-Cw6-restricted p80-88 (ARGPESRLL)<br>SLLMWITQC<br>MLMAQEALAFL<br>YLAMPFATPME<br>ASGPGGGAPR<br>LAAQERRVPR<br>TVSGNILTIR<br>APRGPHGGAASGL<br>MPFATPMEAEL<br>KEFTVSGNILTI<br>MPFATPMEA<br>FATPMEAEL<br>FATPMEAELAR<br>LAMPFATPM<br>ARGPESRLL<br>SLLMWITQCFLPVF<br>LLEFYLAMPFATPMEAELARRSLAQ<br>EFYLAMPFATPM<br>PGVLLKEFTVSGNILTIRLTAADHR<br>RLLEFYLAMPFA<br>QGAMLAAQERRVPRAAEVPR<br>PFATPMEAELARR<br>PGVLLKEFTVSGNILTIRLT<br>VLLKEFTVSG<br>AADHRQLQLSISSCLQQL<br>LKEFTVSGNILTIRL<br>PGVLLKEFTVSGNILTIRLTAADHR<br>LLEFYLAMPFATPMEAELARRSLAQ<br>KEFTVSGNILT<br>LLEFYLAMPFATPM<br>AGATGGRGPRGAGA | Jager et al. Proc. Natl. Acad. Scie. U.S.A. 103(39):14453-8 (2006).<br>Gnjatic et al. PNAS Sep. 26, 2000 vol. 97 no. 20 p. 10919<br>Jager et al. J Exp Med. 187(2):265-70 (1998).<br>Chen et al. J Immunol. 165(2):948-55 (2000).<br>Valmori et al. Cancer Res. 60(16):4499-506 (2000).<br>Aarnoudse et al. Int J Cancer. 82(3):442-8 (1999).<br>Eikawa et al. Int J Cancer. 132(2):345-54 (2013).<br>Wang et al. J Immunol. 161(7):3598-606 (1998).<br>Matsuzaki et al. Cancer Immunol Immunother. 57(8)1185-95 (2008).<br>Ebert et al. Cancer Res. 69(3):1046-54 (2009).<br>Eikawa et al. Int J Cancer. 132(2):345-54 (2013).<br>Knights et al. Cancer Immunol Immunother. 58(3):325-38 (2009).<br>Jäger et al. Cancer Immun. 2:12 (2002).<br>Zeng et al. Proc Natl Acad Sci USA. 98(7):3964-9 (2001).<br>Mandic et al. J Immunol. 174(3):1751-9 (2005).<br>Chen et al. Proc Natl Acad Sci USA. 101(25):9363-8 (2004).<br>Ayyoub et al. Clin Cancer Res. 16(18):4607-15 (2010).<br>Slager et al. J Immunol. 172(8):5095-102 (2004).<br>Mizote et al. Vaccine. 28(32):5338-46 (2010).<br>Jager et al. J Exp Med. 191(4):625-30 (2000).<br>Zarour et al. Cancer Res. 60(17):4946-52 (2000).<br>Zeng et al. J Immunol. 165(2):1153-9 (2000).<br>Bioley et al. Clin Cancer Res. 15(13):4467-74 (2009).<br>Zarour et al. Cancer Res. 62(1):213-8 (2002).<br>Hasegawa et al. Clin Cancer Res. 12(6):1921-7 (2006). |
| 2 | LAGE-1 | MLMAQEALAFL<br>SLLMWITQC<br>LAAQERRVPR<br>ELVRRILSR<br>APRGVRMAV<br>SLLMWITQCFLPVF<br>QGAMLAAQERRVPRAAEVPR<br>AADHRQLQLSISSCLQQL<br>CLSRRPWKRSWSAGSCPGMPHL<br>ILSRDAAPLPRPG<br>AGATGGRGPRGAGA | Aarnoudse et al. Int J Cancer. 82(3):442-8 (1999).<br>Rimoldi et al. J Immunol. 165(12):7253-61 (2000).<br>Wang et al. J Immunol. 161(7):3598-606 (1998).<br>Sun et al. Cancer Immunol Immunother. 55(6):644-52 (2006).<br>Slager et al. Cancer Gene Ther. 11(3):227-36 (2004).<br>Zeng et al. Proc Natl Acad Sci USA. 98(7):3964-9 (2001).<br>Slager et al. J Immunol. 172(8):5095-102 (2004).<br>Jager et al. J Exp Med. 191(4):625-30 (2000).<br>Slager et al. J Immunol. 170(3):1490-7 (2003).<br>Wang et al. Immunity. 20(1):107-18 (2004).<br>Hasegawa et al. Clin Cancer Res. 12(6):1921-7 (2006). |

TABLE BB-continued

Uterine cancer

| No. | Tumor-associated antigen | Reported immunogenic epitopes | Sources |
|---|---|---|---|
| 3 | HERV-K-MEL | MLAVISCAV | Schiavetti et al. Cancer Res. 62(19):5510-6 (2002). |
| 4 | KK-LC-1 | RQKRILVNL | Fukuyama et al. Cancer Res. 66(9):4922-8 (2006). |
| 5 | KM-HN-1 | NYNNFYRFL EYSKECLKEF EYLSLSDKI | Fukuyama et al. Cancer Res. 66(9):4922-8 (2006). Monji et al. Clin Cancer Res. 10 (18 Pt 1):6047-57 (2004). |
| 6 | Sp17 | ILDSSEEDK | Chiriva-Internati et al. Int J Cancer. 107(5):863-5 (2003). |

SEQUENCE LISTING (272 sequences)

SEQ ID NO: 1 - DNA, 34433 bp, Rhesus Adenovirus 4282 (RhAd4282 / RhAd54) Wild Type
catcatcaataatataccttattctggaaacgtgccaatatgataatgagcggggaggagcgaggcggggccggggtgacgtgcggtgacgcggggtgacgcggggtggcgcgagggcggggcgggtgtgcggaggcgcttagtttttacgtatgcggaaggaggttttataccggaagttgggtaatttgggcgtatacttgtaagttttgtgtagtttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggttcccgagatgtacggtgttttctgcagcgagacggcccggaactcagatgagctgctgaattcagacctgctggaaatttcgaattcgcctgtgcttttgccgccgtcacttcacgacctgtttgatgtggaagtggaccctccggaagatcccaacgaggacgcggtaaatactatgtttccagaatgtctgtttgaggcggctgaggagggttcttacagcggtgaagacggcgggcagggagaggaagtggacctgaagtgctacgaggaatgtctaccttctagcgattctgaaacggaacagacagggggagatggctgtgctgaacctgttgtgaaaaatgaacttgtattagactgtcctgataatcctggtcacggttgccgcgcctgtgattttcatagaaatgccagtggaaatcctgagactctatgtgctctgtgttacctgcgccttaccagccattgtgtatacagtaagtagaaactttttcgctttgtgcatgctggtgggatttttaaagtgcgttgggcttattgttgcgtaatgttttacaggcgacgtgtctgacgcggaaggggatggagatagatcaggctctgctggttctccttgcactttgggggctgtggttccagatggcattattaaacccgtggcggtaagagtttcaggcagacggtgtgcggtcgaaaaaattgaagacttgctgcaggaggaacagatgcaacctttggacctgtccctgaaacgccctaagctgacctaagagtgtttattgtatgcaataaaaagtgttgatctttgaactgtgtttatgtgttgggtgtgtctgtgggtatataagcaggtggatgggaagtgagagcacagctgcttcagatggatctgctaggagacctgagggaatttggcgtggttcggcgcttgctggagttggcctctgacagaacttccaagttttggaggttttgttttggctcaacgcttagcaacgtgctatatagggtcaagaaggagcaggagacgcagtttgctaggctgttggccgatactcctggagtttttgtggctctggatctaggccatcactctcttttccaagagaaaattatcaaaaacttaacttttacgtctcctggtcgcacggttgcttccgctgcctttattacctatattttggatcaatggagcaacagcggcagtcacctgtcgtgggagtacatgctggattacatgtcgatggcgctgtggagggccatgctgcggaggagggtttgcatttacttgcgggcgcagcctccgcggctggaccgagtggaggaggaggacgagccgggggagaccgagaacctgagggccgggctggaccctccaacggaggactaggtgctgaggatgatcccgaagaggggactagtggggctaggaagaagcaaaagactgagtctgaacctcgaaactttttgaatgagttgactgtgagtttgatgaatcgtcagcgtccggagacaattttctggtctgaattggaggaggaattcaggaggggggaactgaacctgctatacaagtatgggtttgaacagttgaaaactcactggttggagccgtgggaggattttgaaaccgccttggacacttttgctaaagtggctctgcgaccggataaggtttacactatccgccgcactgttaacataaagaagagtgtttatgttataggccatggagctctggtgcaggtgcaaaccgccgaccgggtggcctttagttgcggcatgcaaaatctgggccccggggtgataggcttaaatggtgtaacatttcacaatgtaaggtttactggtgaaagttttaacggctctgtgtttgcaaataacacacagctgacgctccacggcgtttacttttttaactttaataacacatgtgtggagtcgtggggcagggtgtctttgaggggctgctgttttcacggctgctggaaggcggtggtgggaagacttaaaagtgtaacatctgtaaaaaaatgcgtgtttgagcgctgtgtgttggctttaaccgtggagggctgtggacgcattaggaataatgcagcgtctgagaatggatgtttccttttgctaaaaggcacggctagcgttaagcataacatgatatgcggcagcggtttgtacccttcgcagctgttaacttgcgcggatggaaactgtcagaccctgcgcaccgtgcacatagcgtcccaccagcgacgcgcctggccaacattcgagcacaatatgcttatgcgctgtgccgttcacctgggccctaggcgaggcgtgtttgtgccttaccagtgtaactttagccataccaagtttttactagaacctgacaccttctctcgagtgtgtttcaacggggtttttgacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatttcggcgctcaagttgtcagtttctacaaacgaggaggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggatttaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggctccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggccgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcaccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggcagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccagctcctcctcttccaggggcacaggttcctccggcagctctgcgacggggacggggcggcgacgtcgtctgaccggcaggcggtccacgaagcgttcgatcatttcgccgcgccggcgacgcatggtctcggtgacggcgcgtccgttttcgcgaggtcgcagttcgaaaacgccgccgcgcagagcgcccccgtgcagggagggtaagtggttagggccgtcgggcagggacacggcgctgacgatgcattttatcaattgctgcgtaggcactccgcgcagggatctgagaacgtcgaggtcgacgggatccgagaacttctctaggaaagcgtctatccaatcgcaatcgcaaggtaagctgaggacggtgggtcgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggctgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtgaggaggcggttctcggtacaggggccagccaacggtggcgggggcgccgggggacaggtcgtccagcatgaggcgatggtagtggtagatgtagcgggagagccaggtgatgccggccgaggtggtcgcggccctggtaaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgtcgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgggagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcaacacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacacacgagaaagtcctgactatcgtgaacgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaatttgcaaggcatgtggggcgttaaggccccggtgggcgatcgagccaccatctccagtctgctgacccccaacactcgcctgctgctgctcttgatcgcgccgttcaccaacagtagcactatcagccgtgactcgtacctgggtcatctcatcactttgtaccgcgaggccatcggtcaggctcagatcgacgagcacacatatcaggagatcactaacgtgagccgggccctgggtcaggaagataccggcagcctggaagccacgttgaactttttgctaaccaaccggaggcaaaaaataccctcccagtttacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccggccgttcattaaccgtctgatggactacttccatcgcgcggccgccatgaacggggagtacttcaccaatgccatcctgaatccgcattggatgcccccgtccggcttctacaccggcgagtttgacctgcccgaagccgacgacggctttctttgggacgacgtgtccgacagcattttcacgccgggcaatcgccgattccagaagaaggagggcggagacgagctccccctctccagcgtggaggcggcctctaggggagagagtccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttccagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcgcccctgtacgataccaccaaggtgtacctggtggacaacaagtcggcggacatcgcctccctgaattatcaaaacgatcacagcaattttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctgaaaaccagcctcccgagtacgaatggtttgagttcaccattcccgagggcaactattccgagaccatgactatcgatctgatgaacaatgcgatcgtggacaattacctgcaagtggggaggcagaacggggtattggaaagcgatatcggcgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggatcagaaagcgccgccccttccaagagggctttcagatcatgtatgaggacctggaaggaggtaacattccaggtttgctagacgtgccggcgtatgaagagagtgttaaacaggcggaggcgcagggacgagagattcgaggcgacacctttgccacggaacctcacgaactggtaataaaacctctggaacaagacagtaaaaaacggagttacaacattatatccggcactatgaataccttgtaccggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctcgggccgaacggcggtagacgataccatagatgccgtgattgccgacgcccgccggtacaaccccggaccggtcgctagcgccgcctccaccgtggattccgtgatcgacagcgtggtagctggcgctcgggcctatgctcgccgcaagaggcggctgcatcggagacgtcgccccaccgccgccatgctggcagccagggccgtgctgaggcgggcccggagggtaggcagaagggctatgcgccgcgctgccgccaacgccgccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgctttagacagcggcaaccccacgcccagcctcaaacctgtgacgctgcagcaggtgctccccgtgagcgccagcacggacagcaagaggggaataaaaagagaaatggaagatctgcagcccaccatccagctcatggtccctaaacggcagaggctggaagaggtcctggagaaaatgaaagtggaccccagcatagagccggacgtcaaagtcaggccgatcaaagaagtggcccctggtctcggggtgcagacggtggatatccagatccccgtcacgtcagcttcgaccgccgtggaagccatggaaacgcaaacggaaacccctgccgcgatcggtaccagggaagtggcgttgcaaaccgacccctggtacgaatacgccgcccctcggcgtcagaggcgacccgctcgttacggccccgccaacgccatcatgccagaatatgcgctgcatccgtctatcctgcccacccccggctaccggggagtgacgtatcgcccgtcaggaacccgccgccgaacccgtcgccgccgccgctcccgtcgtgctctggcccccgtgtcggtgcgccgcgtaacacgccggggaaagacagttaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaatggggtggtgaccggcatccacggcgcggtagatctcgccaaccaagcggtgcagaaagagattgacaggcgtttggaaagctcgcgggtgccgccgcagagaggggatgaggtggaggtcgaggaagtagaagtagaggaaaagctgcccccgctggagaaagttcccggtgcgcctccgagaccgcagaagcgacccaggccagaactagaagaaactctggtgacggagagcaaggagcctccctcgtacgagcaagccttgaaagagggcgcctctccaccctacccaatgacaaaaccgatcgcgcctatggctcggccggtgtacgggaaggactacaagcctgtcacgctagagctccccccgccgccaccgccgccccccacgcgcccgaccgttccccccctgccggctccgtcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagccccggtctcgtgcagttcgcccgcgccaccgacacctacttcagcttgggaaacaagtttagaaaccccaccgtggcccccacccacgatgtaaccacggaccgctcgcaaaggctgaccctgcgttttgtgcccgtagaccgggaggacaccgcgtactcttacaaagtgcgctacacgctggccgtaggggacaaccgagtgctggacatggccagcacctactttgacatccggggagtgctggatcgcggtcccagttttaagccctactcgggtaccgcgtacaattccctggctcccaagggcgctcccaaccctgcagaatggacgaattcagacagcaaagttaaagtgagggcacaggcgccttttgttagctcgtatggtgctacagcgattacaaaagagggtattcaggtgggagtaaccttaacagactccggatcaacaccacagtatgcagataaaacgtatcagcctgagccgcaaattggagaactacagtggaacagcgatgttggaaccgatgacaaaatagcaggaagagtgctaaagaaaacaacgcccatgttcccttgttacggctcatatgccaggcccactaatgaaaaaggaggacaggcaacaccgtccgctagtcaagacgtgcaaaatcccgaattacaattttttgcctctactaatgtcgccaatacaccaaaagcagttctatatgcggaggacgtgtcaattgaagcgccagacactcacttggtgttcaaaccaacagtcactgaaggcattacaagttcagaggctctactgacccaacaagctgctcccaaccgtccaaactacatagcctttagagataattttattggtctcatgtactacaatagcacaggtaacatgggagtactggcaggccaggcttctcagctaaatgcagttgttgacctgcaagacagaaatactgagctgtcctaccaactcatgttggacgccctcggagaccgcagtcggtacttttctatgtggaaccaagctgtggatagttacgatcctgatgtaagaatcatagaaaaccatggcgtagaagatgaattgcctaattattgctttcctttgggaggcatggcagtaaccgacacctactcgcctataaaggttaatggaggaggcaatggatgggaagccaataacggcgttttcaccgaaagaggagtggaaataggttcagggaacatgtttgccatggagattaacctgcaagccaatctgtggcgcagtttcttgtattccaatatcgggctgtatctcccggactctttaaaaatcactcctgacaacatcacgctgccagaaaacaaaaccacctaccagtacatgaacggccgcgtaacgccacccgggctggtggacacctacgttaacgtgggcgcgcgctggtcccccgatgtcatggacagtattaacccttttaatcaccaccgcaacgccggactccgctaccgttccatgctcctgggaaacggacgctacgtgcccttccacattcaggtgccccagaaattctttgcaattaaaaacctgctgctgctccccggttcctatacctacgagtggaacttccgcaaggacgtgaacatgattttgcagagctcgctgggtaacgacctgcgagttgacggggccagcatacgcttcgacagcatcaacctgtatgctaactttttccccatggcccacaacacggcctccaccctggaagccatgctgcgcaacgacaccaatgaccagtccttcaacgactacctgtgcgcagctaacatgctgtaccccatccccgccaacgccaccagcgtgcccatctccatcccgtctcgcaactgggccgcctttaggggttggagtttcacccgcctcaaaaccaaggaaaccccctcgctgggctccgggttcgacccctacttcgtctactccggctccatcccctacctggacggcaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctggttcaaatgctcagccattacaacatcggctaccagggcttctacgtgcccgagaattacaaggaccgcatgtactccttctttagaaacttccaacccatgagccgccaaatagtagactcaacggcttacactaactatcaggatgtgaaactgccataccagcataacaactcagggttcgtgggctacatgggacccaccatgcgagagggacaggcctacccggccaactatccgtaccccctgattggggccaccgccgtgcccagcctgacgcagaaaaagttcctctgcgaccgggtgatgtggaggattcccttctctagcaacttcatgtctatgggttccctcaccgacctggggcagaacatgctgtacgccaactccgctcacgccttggacatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcgttttcccggcttcatgtccccccacaagccggcctgtgccatcgttaacacggccggacgggagaccggaggggtgcactggctcgccttcgcctggaacccgcgtaaccgaacctgctacctgttcgacccttttggtttctccgacgagaggctgaaacagatttaccagttcgagtacgaggggctcctcaagcgcagcgctctggcttccaccccagaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaatcaggaacacctgtatcgctttctggggaaacactctgcctacttccgccgccaccggcagcgcatcgaacgggccacggcctttgaaagcatgagccaaagagtgtaatcaataaaaaccatttttatttgacatgatacgcgcttctggcgtttttattaaaaatcaaagggttcgagggaggggtcctcgtgcccgctggggagggacacgttgcgatactggaaacgggcgctccaacgaaactcggggatcaccagccgcggcaggggcacgtcttctaggttctgcttccaaaactgccgcaccagctgcagggctcccatgacgtcgggcgccgataccttgaagtcgcagttagggccggagctcccgcggctgttgcggaacacggggttggcacactggaacaccagcacgccggggttgtggatactggccagggccgtcgggtcggtcacctccgacgcatccagatcctcggcgttgctcagggcaaacggggtcagcttacacatctgccgcccaatctggggtactaggtcgcgcttgttgaggcagtcgcagcgcagagggatcaggatgcgccgctgcccgcgttgcatgatagggtaactcgccgccaggaactcctccatttgacggaaggccatctgggctttagcgccctcggcgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgaccgttctcgctggttacatccatttccaacacgtgctccttgcagaccatctccactccgtggaagcagaacaggacgccctcctgctgggtactgcgatgctcccatacggcacatccggtgggctcccagctcttgtgttttacccccgcgtaggcttccatgtaagccattaggaatctgcccatcagctcggtaaaggtcttctgattggtgaaggtcagcggcaggccgcggtgctcctcgttcaaccaagtttgacagatcttgcggtacacggctccctggtcgggcagaaacttaaaagcccctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagctgaggcgcctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggcagtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgatcgtcttcagctactttgagctgccggacgagcaccctcagggtccggctcacgggttgaaactcgagatcgagaacgcgctcgagtctcgcctcatcgacaccttcaccgcccgacctctcctggtagaaatccaacgggggatcactaccatcaccctgttttgcatctgttccacacccgaattacatgaagatctgtgttgtcatctttgtgctgaatttaataaatagctgttggacttcatctgaggacaactttgtgccctttaaaggtaccatagacaccattgttttctctgaatctaccaattcaattaccttaaattgcacctgcgctaacgaactaattcagtggcgagccaacagatccttttgtaaagcctttttccgcgacgtcacttaccccagcaataactcgctctgtaaattttgttctcgggaagctttaactctatatcctccatttgttaaaggtacttacttgtgcattggctctggtggtggaaatccttgttttcaccgttggtaccttgatataaaaaactcctcttttcctaccacttcaacgccttacaaacaaaagcaggtaaactatttaccttatataggcttacttgctttcgttttgcttttaattgctaattacttacttgtttataatctgcacacttactactaacatgttccttttactatttgttactgctgttgccgctcaaacacttgagaagccttaccagctttatgccgaagtcggttccgagattaccataccctactgtagattcactcaatgtccaggagatgtaatatggtatatggaaatgatcaattctcctcccattttcaattttaccatttctggtgtgtttactggccaacggctctgcgagtacacagcaggttccataaaaacatggaactatctttctcttcaatacaattgcaaccacaaaaatttaaatttgttcaatctccaaattaccgactccgccgtatataatgtaaagaacatagagcagtatgtagagtacaacacctactacaagctaaacgttatttatatccctgagcctaagtgtgctgtaaccacgtcttaccttggccgccaggctacgggagatgaatactgccttattgaaatcaactgcaccaactccaagcatcctaacacagttatttttaacaaccgctcggggaattattttgttaaagaacgcggcggaaagggacctttacctaactactacgaaaccttttttgacatttatggaattacaaaatcttttacttttacctacccttttgataccctgtgtcaagaaatcaactctgttgattcacttaccgcacttaccgattttacccccatttttatttccatcattgttattgccgttatagttattataattagtataggactcttttgcttttaccgccaaaaaaacaagtccaaagccaaagaaaacactaaagttaacattcaactgttataatcctttgttttccagcatggtagccgctctctgcattcttttctgcttgccaatcatctgcgtttctacaaccttcgcggctacatcccatctggataccgactgcttgtctccttttttggtttatctgatattgacttttgtggtctgcacttctattaccagtatcgcctgtttttttgtaacaatttttcaagccgccgattacatatacgtaagatttgcctactttaggcaccaccccgagtacagaaatcagcaagtagccactctactttgtttagcatgataattcttttagcgctgtgcactctaatgtgccttggagactgccactgcccttttaccaaaccttggtccttttactcctgttataatgtattacctgaaactcccatcgcttggctctacgtagccacagcagctttagtctttgtggccacctgcatcggagttcaactttatttctacttaaaaattggatggcttcatcccccagaagatttacccagatatcctcttgttaataactttcagcagcctctgccgcctcctgatcttccgcgagctccctccgttgttagctactttcaactcaccggtggagatgactgacactcaggacattaacattactgtggaaagaatagctgctcagcgtcagcgagagacgcgggtgatggagtacgtggaactacagcagcttaaagagtcccactggtgtgaaaaaggagtgctttgccatgttaagcaagcagccctttcttacgatgtcagcactcagggacatgaactgtcctacactttgcctttacagaaacaaaccttctgcaccatgatgggctctacctccatcacaatcacccaacaagccgggcctgtagagggggctatcctctgtcactgtcacgcacctgattgcatgtccaaactaatcaaaactctctgtgctttaggtgatatttttaagatgtaaatcaataataaacttaccttaaatttgacaacaattttctggtgacatcattcagcagcaccactttaccctcttcccagctctcgtatgggatgcgatagtgggtggcaaacttcctccaaaccctaaaagaaatattggtatccacttccttgtcctcacccacaattttcatcttttcatagatgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtcctctccgcgtcacagacaacaaacttacatttaacttcacatcaccactccgttatgaaaatgaaaaccttacttttaaatatacagagcctcttaaacttataaataacagccttgccattgacatcaattcctcaaaaggccttagtagcgtcggaggctcacttgctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccacttataaacaacgcctttagtattcgacagaacgacagtacggcctcaaaccctacctacaacgccctggcgtttatgcctaacagtaccatatatgcaagagggggaggtggtgagccacgaaacaactactacgtccaaacgtatcttaggggaaatgttcaaaaaccaatcattcttactgtaacctacaactcagctgccacaggatattccttatcttttaagtggactgctcttgcacgtgaaaagtttgcaaccccaacaacttcgttttgctacattacagaacaataaaaccgtgtaccccaccgtttcgtttttttcagatgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacaattaaactaggaaacggcctcactctagacaaccagggacaactaacatcaaccgctggggaagtagaacctccactcactaacgctaacaacaaacttgcactggtctatagcgaacctttagcagtaaagcgcaacagcctaaccttatcgcacaccgctccccttgttattgctgataactctttagcattgcaagtttcagaacctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatactggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcgatggaaacatagctgtttctcctcaagttacatcgcctgacaccttatggaccactgccgatccatccccaaattgttccatctacactgatttagatgccaaaatgtggctctcgttggtaaaacaagggggtatggttcacggttctgttgctttaaaagcattaaaaggaaccctattgagtcctacggaaagtgccattgttattatactacattttgacaattatggagtgcgaattctcaattatcccactttgggcactcaaggcacattgggaaataatgcaacctggggttataggcagggagaatctgcagacactaatgtactcaatgcactagcatttatgcccagttcaaaaaggtacccaagagggcgtggaagcgaagttcaaaatcaaactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataaaacaactttcttttttaatttcttttttattttacacgaacagtaagacttcctccccccctccatttgacagcatacaccagcctctcccccttcatggcagtaaactgttgtgagccagtccggtatttgggagtcaagatccaaacagtctctttggtgataaaacgtggatccgtgatggacacaaatccctgggacaggttctccaacgtttcggtaaaaaactgcgtgccaccctacaaaacaaacaggttcaggctctccacgggttatctccccgatcaaactcatacagggtaaaggtgcgatgatgttccactaaaccacgcaggtggcgctgtctgaacctctcggtgcgactcctgtgaggctggtaagaagttagattgtccagcagcctcacagcacgtatcatcagtctacgagtacgtctggcgcagcagcgcatttgaatctcactgagatttcggcaagaatcgcacaccatcacaatcaggttgttcataatcccatagctgaacacgctccagccaaagctcattcgctccaacagcgccaccgcgtgtccgtccaaccttactttaacataaatcaggtgtctgccgcgtacaaacatactacccgcatacagaacttcccggggcaaacccctgttcaccacctgcctgtaccagggaaacctcacatttatcagggagccatagatagccattttaaaccaattagctaacaccgccccaccagctctacactgaagagaaccgggagagttacaatgacagtgaataatccatctctcatagcccctgattacctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccggcgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcaatgcacacctcaaacctacagatgtctcggtacagttccaaacacgtagtgagggcgagttccaaccaagacagacaggctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccactgccaaagttcacccacacccacgaaacccgcgaaaatccagcgccgtcagcacttccgcaatttcagtctcacaacgtcacttccgcgcgccttttcacattcccacacccgcccacaaaccccgccctcgcgccaccccgcgtcaccccgcgtcaccgcacgtcaccccggccccgcctcgctcctccccgctcattatcatattggcacgtttccagaataaggtatattattgatgatg

SEQ ID NO: 2 - DNA, 35178 bp, Rhesus Adenovirus 4300 (RhAd4300 / RhAd55) Wild Type
catcatcaataatataccttattctggaaacgtgccaatatgataatgagcggggaggagcgaggcggggccggggtgacgtgcggtgacgcgggctgacgcgggtggcgcggggtggcgcgagggcggggcgggtgtggggaggcgcttagtttttacgtatgcggaaggaggttttataccggaagttgggtaatttgggcgtatacttgtaagttttgtgtaatttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggttcccgagatgtacggtgttttctgcagcgagatggcccggaactcagatgagctgcttaatacagatctgccggatgttcccaactcgcctgtggcttcgcctccgtcgcttcacgatcttttcgatgtggaagtggatccaccgcaagatcccaacgaggacgcggtaaacagtatgttccctgaatgtctgtttgaggcggctgaggagggttctcacagcagtgaagagagcagacggggagaggaactggacttgaaatgctacgaggaatgtctgccttctagcgattctgaaacggaacagacagggggagacggctgtgagtcggcagtgaaaaatgaacttgtattagactgtccagaacatcctggtcatggctgccgtgcctgtgcttttcatagaaatgccagcggaaatcctgagactctatgtgctctgtgttatctgcgccttaccagcgattttgtatacagtaagtaaagtgttttcattggcgtacggtaggggattcgttgaagtgctttgtgacttattatgtgtcattatttctaggtgacgtgtccgacgtggaaggggaaggagatagatcaggggctgctaattctccttgcactttgggggctgtggttccagttggcattattaaacccgtggcggtcagagtctcaggcagacggtgcgcagttgaaaaaattgaagacttgctgcaggaagaacagacgcaacctttggacctgtccatgaaacgccctaagctgacttaagtgtgtttattgtatgcaataaaagtgttgatctttgaactgtgtttatgtgttgggtgtgtctgtgggtatataagcaggtggatgggaagtgagagcacagctgcttcagatggatctgctaggagacctgagagaatttggcgtggttcggcgcttgctggagttggcctctgacagaacttccaagttttggaggttttgttttggctcaacgcttagcaacgtgctatatagggtcaagaaggagcaggagacgcagtttgctaggctgttggccgatactcctggagtttttgtggctctggatctaggccatcactctcttttccaagagaaaattatcaaaaacttaacttttacgtctcctggtcgcacggttgcttccgctgcctttattacctatattttggatcaatggagcaacagcgacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttattggccatggagctctggtgcaggtgcagaccccagaccgggtggctttcaattgcggcatgcagagtttgggccccggggtgataggtttgaatggagttacatttcaaaatgtcaggtttactggtgatgattttaatggctctgtgtttgtgactagcacccagctaaccctccacggtgtttacttttttaactttaacaatacatgtgtggagtcatggggtagggtgtctctgaggggctgcagttttcatggttgttggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgtgccattcacctaggtgctagacgcggcgtgtttatgccgtatcaatgtaactttagccatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaatgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaggatgccctgaatgtgatcctgactcgcctggagatcatgtcacgtcgcctggacgaactggctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacaaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttttcggcccggtagaggatctgcctgaagatggcgtgggagttggaagagatggtggggcgttggaagacgttaaagttggctccgggcagtcccacggagtcttggatgaactgggcgtaggattcccggagcttgcccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccattggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagtccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctctacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggagacggatgagatcggcgaccgtgtcgcgtacctcctgttcgaaagcgccccgaggcgcctctgcttcttcctccggctcctcctcttccaggggcatgggttcctccgacagctctgcgacggggacggggcggcgacgtcgtcgtctgaccggcaggcggtccacgaagcgctcgatcatttcaccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggtcgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttaatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtgaggaggcggctctcggtacaggggccagccaacggtggcgggagcgccgggggacaggtcatccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctggcccgtgaggcgggcgcaatcttgtacgctctagatggaaaaaagacagggcggtcatggactcccttccgtagctcggggggtaaagtcgcaagggtgcggcggcggggaaccccggttcgagaccggctggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagagttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagtcgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacgtgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggtcaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtaccgtcgcgcaccaacccgacgcacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgccttaccacggacgtgaaggaggcgctggctcagaaggagcggtttctgagggatagcaatctgggttctctggtggcactgaacgcctttctgagcacgcagccggccaacgtgccccgcgggcaggaggattacgtgagcttcatcagcgctctgagactgctggtgtccgaggtgccccagagcgaggtgtaccagtctgggccggattacttttttcagacgtcccgacagggcttgcaaacggtgaacctgactcaggcctttaaaaacttgcaaggtatgtggggcgttaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagattgacgagcatacatatcaggagatcactaacgtgagccgggccctgggtcaggaagataccggcagcctggaagccacgttgaactttttgctaaccaaccggaggcaaaaaataccctcccagtttacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggcgagtttgacctgcccgaagccgacgacggctttctttgggacgacgtgtccgacagcattttcacgccgggcaatcgccgattccagaagaaggagggcggagacgagctccccctctccagcgtggaggcggcctctaggggagagagtccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaactcggcagccccgatacgagtggttcgagtttaccattccagagggcaactattccgaaactatgactatcgatctcatgaataacgcgatcgtggacaattacctgcaagtggggagacagaacggggtgctggaaagcgatatcggcgtgaaattcgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttaggaattagaaagcgccgcccattccaagagggctttcaaatcatgtatgaggacctggagggaggtaatatacccgccttactggacgtgtcgaagtacgaagctagcatacaacgcgccaaagcggagggtagagagattcggggagacacctttgcggtagctccccaggacctggaaatagtgcctttaactaaagacagcaaagacagaagctacaatattataaacaacacgacggacaccctgtatcggagctggtttctggcttacaactacggagaccccgagaaaggagtgagatcatggaccatactcaccaccacggacgtgacctgtggctcgcagcaagtgtactggtccctgccggatatgatgcaagacccggtcaccttccgcccctccacccaagtcagcaacttcccggtggtgggcaccgagctgctgcccgtccatgccaagagcttctacaacgagcaggccgtctactcgcaacttattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtggtggctcctaaagttctttctagtcgcaccttctaaaaacatgtccatcctcatctctcccgataacaacaccggctggggactgggctccggcaagatgtacggcggagccaaaaggcgctccagtcagcacccagttcgagttcggggccacttccgcgctccttggggagcttacaagcgaggactctcgggtcgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggcaggcagaagggctatgcgccgcgctgccgccaacgccgccgccgggagggcccgccgacaggctgcccgccaggctgctgctgccatcgctagcatggccagacccaggagagggaacgtgtactgggtgcgtgattctgtgacgggagtccgagtgccggtgcgcagccgacctccccgaagttagaagatccaagctgcgaagacggcgtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggaggatggcggagtggaatttattaggagtttcgccccgcgacgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaattaaaagagaaatggaagatctgcatcccaccatccaactcatggtccctaaacggcagaggctggaagaggtcctggagaagatgaaagtggaccccagcatagagccggatgtaaaagtcagacctattaaggaagtggcccccggtcttggggtgcaaacggtggacattcaaatccccgtcaccaccgcttcaaccgccgtggaagccatggaaacgcaaacggaaacccctgccgcgatcggtaccagggaagtggcgttgcaaacggagccttggtacgaatacgccgcccctcggcgtcagaggcgttccgctcgttacggccccgccaacgccatcatgccagaatatgcgctgcatccgtctatactgcccactcccggataccggggtgtgacgtatcgcccgtctggaacccgccgccgaacccgtcgccgccgccgctcccgtcgcgctctggcccccgtgtcggtgcggcgtgtgacccgccggggaaagacagtcgtcattcccaacccgcgttaccaccctagcatcctttaataactctgccgttttgcagatggctctgacttgccgcgtgcgccttcccgttccgcactatcgaggaagatctcgtcgtaggagaggcatgacgggcagtggtcgccggcgggctttgcgcaggcgcatgaaaggcggaattttacccgccctgatacccataattgccgccgccatcggtgccatacccggcgttgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcaaatgctccgagataaactgaaggacaccaacttccaagaaaaagtggtcaatggggtggtgaccggcatccacggtgcggtagatctcgccaaccaagcggtgcagaaagagattgacaggcgtttggaaaactcgcgggtgccgccgcagaggggggatgaggtggaggtcgaggaagtagaagtagaggaaaagctgcccccgctggagaaagttcccggtgcgcctccgaggccgcaaaagcggcccaggccagaactagaagaaactctggtgacggagagcaaggagcctccctcgtacgagcaagccttgaaagagggcgcctctccaccctcctacccgatgactaagccgatcgcacccatggctcgaccggtgtacgggaaggactacaagcctgtcacgctagagctccccccgccaccaccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagtgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggatcgctcgcagaggctgaccctgcgcttcgtgcccgtagaccgggaggacaccgcgtactcttacaaagtgcgctacacgctggccgtaggggacaaccgggtgctcgacatggccagcacctactttgacatccggggggtgctcgatcgcggtcccagcttcaagccctattcggggaccgcctacaactccctggctcccaagggcgcccccaaccccgctgaatgggcagattctgacagcaaactgaaagtgagggcacaggcaccttttgtcagctcctacggtaataatgcgattacaaaggaaggtattcaggtaggagtaattttaacagactccggacaaacagcacaatatgcggacaaaacgtatcagcctgagccgcagattggagaactacagtggaacagcgaagtaggaaccaatgataaagtagcgggaagggtgcttaagaagacgactccaatgtttccctgttatggttcatacgccaagcctaccaatgcaaaaggagggcaggcgacacagcctgctagtcaagaaactcaaaatccagaattgcagttttttgctgcttccagcaccaccgtcaacactccaaaagcagtattatacgcagaggacgtgtctattgaagctccagacactcacctggtatttaaaccatcagtaactgaaggaactacaagttcggaagctctactgacacaacaagctgcccctaacaggccaaactatattgcctttcgggacaattttattggcctaatgtattacaatagcactggaaacatgggagtgctggccggacaggcgtcgcaactcaatgcggtggtcgatttgcaagacagaaacacagaactgtcataccagctaatgcttgacgctctgggagatagaagtcgctacttctctatgtggaatcaagccgtggacagttacgatccagatgttagaatagtggaaaatcacggcgtcgaagatgaattgcctaattactgcttccctttgggcggtatggcagtgactgacacctactcgcctataaagcttaatggtgggcaaaacggatgggaagctaataatgacgtttatgccgaaagaggagtggaaataggctcagggaacctgttcgccatggagatcaacctgcaggccaacctgtggcgcagtttcttgtattccaacatcgggctgtatctccccgactccctaaaaatcacccccgacaatatcacgctgccagagaacaaaaacacttatcagtacatgaacggtcgcgtgacacctcccgggctcatagacacctacgtcaacgtgggtgcgcgctggtcccccgatgttatggacagcatcaaccccttcaaccaccaccgcaacgcggggctgcgttaccgctccatgctgctgggcaacggccgctacgtgcccttccacatccaggtgccccagaaattctttgccattaagaacctgctgctgctccccggttcctacacctacgagtggaacttccgcaaggacgtcaacatgatcttgcagagctcgctgggcaatgacctgcgagtggacggggccagcatccgcttcgacagcatcaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtgatgtggaggatccccttctctagcaacttcatgtcgatgggctccctcaccgacctggggcagaacatgctgtacgccaactccgcgcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggttccagcgaacaggagttgcaggccattgttcgcgacctgggctgcgggccctactttttgggcaccttcgacaagcgttttcccggcttcatgtccccccacaagccggcctgcgccatcgttaacacggccggacgggagaccgggggggtgcactggctcgccttcgcctggaacccgcgcaaccgcacctgctacctgttcgacccttttggtttctccgacgaaaggctgaagcagatctaccaattcgagtacgaggggctcctcaagcgcagcgctctggcttccaccccagaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgagcaggccacggcctttgaaagcatgagccaaagagtgtaatcaataaaaaccattttttatttaacatgatacgcgcttctggcgtttttattagaaatcgaagggttcgagggaggggtcctcgtgcccgctgggaagggacacgttgcggtactggaaacgggcgctccaacgaaactcggggatcaccagccgcggcaggggcacgtcttctaggttctgcttccaaaactgccgcaccagctgcagggctcccatcacgtcgggcgccgagatcttgaagtcgcagttagggccggagctcccgcggctgttgcggaacacggggttggcacactggaacaccagcacgcctgggttgtggatactggccagggccgtcggatcggtcacctccgacgcgtccagatcctcggcgttgctcagggcaaacggggtcagcttgcacatctgccgcccgatctggggcaccaggtcgggtttgttgaggcaatcgcagcgcagagggatcaggatgcgtcgctgcccgcgttgcatgatagggtaactcgccgccaggaactcctccatttgacggaaggccatctgggctttgacgccctcggtgaaaaacagcccacaggacttgctagaaaatacgttattgccgcagttaatgtcttccgcgcagcagcgtgcatcttcgttcttcagctgaaccacgttacgcccccagcggttctggaccaccttggctttcgtaggatgctccttcagcgcccgctgcccgttctcgctggtcacatccatttccaccacgtgctccttgcagaccatctccactccgtggaagcaaaacaggacgccctcctgccgggtattgcgatgctcccatacggcgcatccggtgggctcccagctcttgtgttttacccccgcgtaggcttccatgtaagccatgaggaatctgcccatcagctcggtgaaggtcttctgattggtgaaggttagcggcaggccgcggtgctcctcgttcaaccaagtttgacagatcttgcggtacacggctccctggtcgggcagaaacttaaaagccgctctgctgtcgttgtccacgtggaacttctccatcaacatcgtcatgacttccatgcccttctcccaggcagtcaccagcggcgcgctctcggggttcttcaccaacacggcggtagaggggccctcgccggccccgacgtccttcatggtcattctttgaaactccacggagccgtccgcgcgacgtactctgcgcaccggagggtagctgaagcccacctccaccacggtgccttcgccctcgctgtcggagacaatctccggggatggcggcggcggcgcgggtgttgccttgcgagccttcttcttgggagggagcggaggcacctcctgctcgcgctcggggctcatctcccgcaagtagggggttatggagctgcctgcttggttctgacggttggccattgtatcctaggcagaaagacatggagcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggaaggggacaacgcgcgtctggccgtcctcaagcgctgcatagaagtttcccacttcgcctaccccgccctcaacctgccgcccaaagttatgaaatcggtcatggatcagctactcatcaagagagctgagcccctggatcccgaccaccctgaggcggaaaactcagaggacggaaagcccgtcgtcagcgacgaggagctccagcggtggctggagaccaaagacccccagcagttgcaagagaggcgtaagatgatgatggcggccgtgctggtcaccgtggagctagaatgcctgcaacggtttttcagcgacgtggaaacgctgcgcaaaatcggggagtccctgcactacaccttccgccagggctacgtccgccaggcctgtaagatctccaacgtggagctcagcaacctggtctcctacatgggcatcctccacgagaaccggctggggcagagcgtgctgcactgcaccttgcagggcgaggcgcggagggactacgtccgcgactgcgtctacctcttcctcacccttacctggcagaccgccatgggcgtctggcagcagtgcttggaagagagaaacctcaaagagctagacaaactcctctgccgccagcggcgcgccctgtggtccggtttcagcgaacgcactgtcgcctgcgccctggcagacatcattttcccggagcgcctgatgaaaaccctgcagaacggcctgccggatttcataagtcagagcatcttgcaaaacttccgctccttcgtcctggagcgctccgggatcttgcccgccatgagctgcgcgctaccttctgactttgttcccctttcctaccgcgagtgccctcccccactgtggagccactgctacctcttccaactggccaactttctggcctaccactccgacctcatggaagacgtgagcggagaggggctgctcgagtgccactgtcgctgcaacctctgcaccccccacagatcgctggcttgcaacaccgagctgctcagcgagacccaggtcataggtaccttcgagatccagggaccccagcagcaagagggtgcttccggcttgaagctcactccggcgctgtggacctcggcttacttacgcaaatttgtagccgaggactaccacgcccacaaaattcggttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagaactgtgggacagccaggcagaggaggtgtcagaggacgaggaggagatggaaagctgggacagcctagacgaggaggaggacgagctttcagaggaagagacgaccgaagaaaaaccacctgcatccagcgcgccttctctgagccgacagccgaagccccgacccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacggtacctcctcttccatcacggtgtggccttccctcgcaacgttctctattattaccgtcatctctacagcccctacgaaacgctcggagaaaaaagctaaggcctcctctgccgcgaggaaaaactccgccgctgccgccgccgccaaggatccaccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcagtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcgcctggacgctacccggacgccttcattcccaactttgacgcagtgagtgaatccgtggacggctacgactgatgacagatggtgcggccgtgagagctcggttgcgacatctgcatcactgccgtcagcctcgctgctacgctcgggaggcgatcgtgttcagctactttgagctgccggacgagcaccctcagggaccggctcacgggttgaaactcgagatcgagaacgcgctcgagtctcgcctcatcgacgccttcaccgcccgacctctcctggtggaaaccgaacgcgggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctcccagaggtatcatacaaactgtttactttgacaactctactactctcctaaccctcaactgctcttgcactaacgaactaattcagtggattgcaaacggtgtaatctgcataacctttcttaactccgcggtttttcaccaacgcaacaactctctgtgcggtaatactactctgcacaccttaaccctcacaccaccttttgcggaacttcaatacttttgcatcggggtaggaaagggaccgagttgctggcaccgttcttttttaaaaaaagctgttccgtctacaattagctctgcttccgctcctaacaattccacttctttaaatttcactcgctcagcctatttaacaactcacacttcttggcaacctgttgttactttaacagctcttatcttgttagtgctgtttaactttgttttaattgaatacctagtatcactatgaacaagataattattgaggccttcattattctatgtgtctcctccatcttatgcagcacggaagacactgaagttgtttatgttaaaataggatctaacaaatctcttgaaacaacctttttacctgatccccccgcaataccgcatattatttggtacaaagaggtttttaattccatttttggcccgcaaaccccctcatattatttttcaggggttaaatattgtgaaatttctgaatctaaaaaccaaatctgggatcattatccggcagaatttaattgcataaacaaaagcctcaattttttcaacttaaaaccttcagattctggcctgtaccaagctcaggttattaacaacagtataatatacagtaattacatctatctgtatgttatagatcttccagctccacagtgcgttgtcacttcttattacctcgaagtacaacataagccaagtacatattgcctcatagaaattaactgctcaaaatcagaatatcctgctgaagtcttttttaatggcaaacgaagcaatttacatcactatgtcacagatactgggaacaaacctttgccaaattatttcactaccactattaaagcttatggattaacacaaacttacaaccattcttatgaatttaacgacctttgtaatgatataattgctcttgaaacaggtgctgatttcatgccaattttcatagttaccatagtggtgagcgtaatagtcattattctaggcattacgtacctcatttaccactgtagaactttaaaaacccataaaaaaaccaagcctcctgaaatccgcttactttaatgttttccagaatggtagctgccttcttcattcttctctgtataccaatcatctgcgcctccacaacttttgccgctgtttcccacctggaaccagactgtctaccaccttttgttgtatacctaatactgacttttgtggtctgtacagccattaccagtatagcctgcttttttgtaacaattttccaagccgccgattacctctacgtacggtttgcttactttagacatcaccccgagtatcggaatcaaaacgtagcctctctgctttgtttagcatgattcgcatttttatactttgtaagctctttaccaccacaatgtgtcaatgcccttttaccaaaccctggtccttttacacttgttataatgtattacccgaaacccccattgcctggctttacgtagccacagcggctttagtttttgtagcgacctgcattggcgttaaactgtacttctacttaaaaattggatggcttcatcccccagaagatttaccccgatatcctcttgttaataactttcaacagcctctgccgcctcctgaccttcttcctcgagctccctctgttgtgagctactttcaactcaccggtggagatgactgactctcaggacattaatattagtgtggaaagaatagctgctcagcgtcagcgagaaactcgagtgatggagtaccttcaactacagcagcttaaggagtcccactggtgtgagaaaggagtgctgtgccatgttaagcaggcggccctttcttacgatgtcagcctccagggacatgaactgtcttacactttgccttcgcaaaaacaaaccttctgcaccatgatgggtcctacctctatcacaatcacccaacaaaccggacctgtcgagggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctgagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcaggtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttaacagcgagccccaactgggcgtacactttaatccccctatcaccgtgcaacaaggcggtctggccttaaatacgggggatggtttgcaagtatatcttaacaaactaacgctaaacataggcagagacttgcaatatgaaaacgggtcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgagtcagtccggtatttgggagttaagatccaaacagtctctttggtaatcagatgtcgatccgtgatggacacaaatccctggggcaggttctccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcactgagattccggcagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcaaacccctgttcaccacctgcctgtaccagggaaacctcacatttatcagggagccatagatagccattttaaaccaattagctaacaccgccccaccagctctacactgaagagaaccgggagagttacaatgacagtgaatgatccatctctcataacccctgatggtctgatggaaatccagatctaacgtggcacaacagatacacactttcatatacattttcatcacatgtttttcccaggccgttaaaatacaatcccaatacacgggccactcctgcagtacaataaaactaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagaaaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggtgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaggtaattttcatttctccactcgcgaataatgtcgcggcaaatagtctgaaggttcatgccgtgcatattaaaaagctccgaaagggcgccctctatagccatgcgtagacacaccatcatgactgcaatatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgtgcaaccaaaaatcactaagctgctcctttaaaaagtccagtacttctatattcagtccgtgcaagtactgaagcaactgtgcgggaatatgcacaacaaaaaaaatagggcggctcagatacatgttgacctaaaataaaaagaattattaaactaaagaagcttggcgaacggtgggataaatgacacgctccagcagcagacaggcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagcgggaatatccaacgacagctgcaaagacagcaaaacaatccctctgggagcaatcacaaaatcctccggtgaaaaaagcacatacatattagaataaccctgttgctggggcaaaaaggcccggcgtcccagcaaatgcacataaatatgttcatcagccattgccccgtcttaccgcgtaaacagccaggaaaaaatcgagctaaaatccacccaacagcctatagctatatatacactccgcccaatgacgctaataccgcaccacccacgaccaaagttcacccacacccacaaaacccgcgaaaatccagcgccgtcagcacttccgcaatttcagtctcacaacgtcacttccgcgcgccttttcactttcccacacacgcccttcgcccgccccgccctcgcgccaccccgcgtcaccccacgtcaccccggccccgcctcgctcctccccgctcattatcatattggcacgtttccagaataaggtatattattgatgatg

SEQ ID NO: 3 - DNA, 34449 bp, Rhesus Adenovirus 4302 (RhAd4302 / RhAd56) Wild Type
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggtccccgagatgtacggtgttttctgcagcgagacggtccggaactcagatgagctgcttaatacagatctgctggatgttcccaactcgcctgtggcttcgcctccgtcgcttcatgatcttttcgatgtggaagtggatccaccgcaagatcccaacgaggacgcggtaaacagtatgttccctgaatgtctgtttgaggcggctgaggagggttctcacagcagtgaagagagcagacggggagatgaactggacttgaaatgctacgaggaatgtctgccttctagcgattctgaaacggaacagacagggggagactgctgtactgagccggtagtgaaaaatgaacttgtattagactgtcctgatcaacctggtcatggctgccgtgcctgtgcttttcatagaaatgccagcggaaatcctgaaactttatgtgctctgtgttacctgcgtcttaccagcgattttgtatacagtaagtaggagctttttcgatttgcgcatggtggtgggattgttaaagtgtgttgggcttattgtttgtgtaatgttttacaggtgacgtgtctgacacggaaggggacggagatagattagggtctgctaattctccttgcactttgggggctgtggttccagttggcattattaaacccgtggcggtcagagtctcaggcagacggtatgcagttgaaaaattggaagacttgctgcaggaagaacagacggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcctatattttggatcaatggagcaacagcaacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttatcggccatggagctctggtgcaggtgcagaccccagaccgggtggctttcaattgcggtatgcagagtttgggccccggggtgataggtttgaatggagttacatttcaaaatgtcaggtttactggtgatgattttaatggctctgtgtttgtgactagcacccagctaaccctccacggtgtttacttttttaactttaacaatacatgtgtggagtcatggggtagggtgtctctgaggggctgcagttttcatggttgctggaaagcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgcgccgttcacctaggtgctagacgcggcgtgtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgtcaccgaggagctgaggacggaccaccacatgctgtcttgcctgcgtaccgactatgaatccagtgatgaggagtgaggtgaggggcggagccacaaagggtataaaggggcatgaagggtggacgcggtgtttcaaaatgagcgggacgacggacggcaatgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactatataaccaactggccactgcagctgtggcgtctcggtctctggttcaagaagatgccctgaatgtgatcttgactcgcctggagatcatgtcacgtcgcctggacgaactggctgcgcagatatcccaagctaaccccgataccgcttcagaatcttaaataaagacaaacaaatttgttgaaaagtaaaatggctttatttgttttttttggctcggtaggctcgggtccacctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggagagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggtggatttgatatttacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgattaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccggacagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggatgggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtgtcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgtagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttggatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcgaccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggatcccgcacttttggcatccatgcagagtcaaccttcgggcgtgaccgcctccgatgactgggcggcggccatggaccgcatcatggcgctgaccacccgcaaccccgaggcttttagacagcaaccccaggccaaccgtttttcggccatcttggaagcggtggtaccgtcgcgcaccaacccgacgcacgagaaagtcctgactatcgtaaacgccctggtagacagcaaggccatccgccgcgacgaggcgggcttgatttacaacgctctgctggaacgggtggcgcgctacaacagcactaacgttcagaccaatctggatcgtctcaccaccgacgtgaaggaggcgctggctcagaaggagcgctttctgagggacagcaatctgggctctctggtggcactcaacgccttcctgagcacgcagccggccaacgtgccccgcgggcaggaggactacgtgagctttatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgcgactcgtacctgggtcatctcatcactctgtaccgcgaggccatcggtcaggctcagattgacgagcatacatatcaggagatcactaacgtgagccgggccctgggtcaggaagataccggcagcctggaggccacgttgaactttttgctaaccaaccggaggcaaaaaataccctcccagttcacgttaagcgccgaggaggagaggattctgcgatacgtgcagcagtccgtgagtctgtacttgatgcgggagggcgccaccgcttccacggctttagacatgacagctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctttgggacgacgtgtccgacagcattttcacgccggacaatcgccgattccagaagaaggagggcggagacgagctccccctctccagcgtggaggcggcctctaggggagagagcccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattaccaaaacgatcacagcaactttctgactaccgtggtgcagaacaatgacttcaccccgacggaggcgggcacgcagaccattaactttgacgagcgttcccgctggggcggtcagctgaaaaccattctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtgaaatttgataccagaaacttccgactggggtgggatcccgtgaccaagctggtaatgccaggcgtgtacaccaacgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcagcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctaccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctctggccgaacggctgtagacgataccatagacgccgtgattgccgacgcccgccggtacaaccccggaccggtcgctagcgccgcctccaccgtggattccgtgatagacagtgtggtggccggcgccagggcatatgctcgccgcaagaggcggctgcatcggaaacgtcgccccaccgccgccatgctagcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgttacgtcagcttcaaccgccgtggaagccatggaaacgcaaaccgaaacccccgccgcggttggtacgaaagaagtggcgttgcaaaccgacccctggtacgaatttgccaccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgcagccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgagggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacgatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcctggaacccgcgtaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacaaccccatggagcgcaaccccaccatggatctgctcaccggagtgcccaacagcatgcttcacagcccccaggtcgcccccaccctgcgccgtaaccaggaacacctgtatcgctttctggggaaacactctgcctatttccgccgccaccggcagcgcatcgagcaggccacggcctttgaaagcatgagccaaagagtgtaatcaataaaaaccatttttatttaacatgatacgcgcttctggcgtttttattaaaaatcgaacggttcgagggaggggtcctcgtgcccgctgggaagggacacgttgcggtactggaaacgggcgctccaacgaaactcggggatcaccagccgcggcaggggcacgtcttctaggttctgcttccagaactgccgcaccagctgcagggctcccatgacgtcgggcgccgagatcttgaagtcgcagttagggccggagcccccgcggctgttgcggaacacggggttggcacactggaacaccagcacgctggggttgtaaatactggccagggccgttgggtcggtcacctccgacgcatccagatcctcggcattgctcagggcgaacggagtcagcttgcacatctgccgtccgatctggggcaccaggtcgggtttgttgaggcaatcgcagcgcagagggattaggatgcgacgctgcccgcgttgcatgatagggtaactcgccgccaggaactcctccatctgacggaaggccatctgggccttggtaccctcggtgaaaaatagcccacaggacttgctagaaaatacgttattgccgcagttgatgtcttccgcgcagcagcgtgcatcttcgttcttcagctgaaccacgttacgcccccagcggttctggaccaccttggctttcgtaggatgctccttcaacgcccgctgaccgttctcgctggtcacatccatttccaccacgtgctccttgcagaccatctccactccgtggaagcagaacaggacgccctcctgctgggtattgcgatgctcccaaacggcacatccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagccgctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttggaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcagccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaactctcggagaaaaaagctaaggcctcctctgccgcgaggaaaaactccgccgccgctgccgccgccaaggatccgccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcattgccagcatgagcaaggagattcccaccccttacatgtggagctatcagccccagatgggcctggccgcgggggccgcccaggactactccagcaagatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttttccggctcacctggacgctacccggacgccttcattcccaactttgacgcagtgagtgaatccgtggacggctacgactgatgacagatggtgcggccgtgagagctcggctgcgacatctgcatcactgccgccagcctcgctgctacgctcgggaggcgatcgtgttcagctactttgagctgccggacgagcaccctcaggggccggctcacgggttgaaactcgagatcgagaacgcgctcgagtctcgcctcatcgacgccttcaccgcccggcctctcctggtagaaaccgaacgcgggatcactaccatcaccctgttctgcatctgccccacgcccggattacatgaagatctgtgttgtcatctttgcgctcagtttaataaaaactgaactgtttgccgcaccttcaacgccatctgtgatttctacaacaaaaagttcttctggcaaaggtacacaaactgtattttattctaattctacctcatctattgtgctgaactgcgcctgcactaacgaacttatccagtggattgcaaacggtagtgtgtgcaagtacttttgggggaacgagatagttagtagaaataacagcctttgcaagcactgcaactcctccacactaatcctttatcccccatttgttactggatggtatatgtgcgttggctccggtttaaatcctagttgctttcataagtggtttctacaaaaagagacccttcccaacaattctgtttcttttttcaccctgtcctactgctgttctccctctggttactctttcaaacctctaattggtattttagctttgatactgataatctttattaactttataataattaacaacttacagtaaacatgcttgttatcctcctgctcgccacatttttcgctctctctcacgccagaacaagtattgttggcgcaggttacaatgcaactcttcaatctgcttacatgccagattccgaccagataccccatattacgtggtacttacaaacctccaaacctaattcttcattttatgaaggaaacaaactctgcgatgactccgacaacaggacgcacacatttccccacccttcactacaattcgaatgcgtaaacaaaagcttgaagctttacaacttaaagccttcagattctggcttgtatcatgctgtagttgaaaaaagtaatttagaagtccacagtgattacattgaattgatggttgtggacctgacacctccaaaatgtgaggtttcctcctcttaccttgaagttcaaggcgtggatgcctactgcctcatacacattaactgcagcaactctaaatatccagctagaatttactataatggacaggaaagtaatcttttttattatttaacaacaagcgctggtaacggtaaacagttacctgattattttactgctgttgttgaattttccacctacagagaaacgtatgccaagcggccttacaatttctcatacccgtttaacgacctttgcaatgaaatacaagcgctcgaaactggaactgattttactccaattttcattgctgccattgttgtgagcttaattaccattattgtcagcctagcattttactgcttttgcaagcccaaaaaacctaagtttgaaaaacttaaactaaaacctgtcattcaacaagtgtgattttgttttccagcatggtagctgcatttctacttctcctctgtctacccatcattttcgtctcttcaactttcgccgcagtttcccacctggaaccagagtgcctaccgccttttgacgtgtatctgattctcacctttgtttgttgtatatccatttgcagtatagcctgcttttttataacaatctttcaagccgccgactatctttacgtgcgaattgcttactttagacaccatcctgaatacagaaatcaaaacgttgcctccttactttgtttggcatgattaagctattgctaatacttaattatttacccctaatcaactgtaattgtccattcaccaaaccctggtcattctacacctgttatgataaaatccccgacactcctgttgcttggctttacgcagccaccgccgctttggtatttgtatctacttgccttggagtaaaattgtattttattctacacactgggtggctacatcccagagaagatttacctagacatcctcttgtaaacgcttttcaattacagcctctgcctcctcctgatcttcttcctcgagctccctctattgtgagctactttcaactcaccggtggagatgactgactctcaggacattaatattagtgtggaaagaatagctgctcagcgtcagcgagaaacgcgagtgttggaatacctggaactacaacagcttaaggagtcccactggtgtgagaaaggagtgctgtgtcatgttaagcaggcagccctttcctacgatgtcagcgttcagggacatgaactgtcttacactttgcctttgcagaaacaaaccttctgcaccatgatgggctctacctccatcacaatcacccaacaagccgggcctgtagagggggctatcctctgtcactgtcacgcacctgattgcatgtccaaactaatcaaaactctctgtgctttaggtgatatttttaaaatgtaaatcataataaacttaccttaaatttgacaacaattttctggtgacatcattcagcagcaccactttaccctcttcccagctctcgtatgggatgcgatagtgggtggcaaacttcctccaaaccctaaaagaaatattggtatccacttccttgtcctcacccacaattttcatcttttcatagatgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtccgctccgcgtcacagacaacaaacttacatttaacttcacatcaccactccgttatgaaaatgaaaaccttacttttaactatacagagcctcttaaacttataaataacagccttgccattgacatcaattcctcaaaaggccttagtagcgtcggaggctcactagctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccgcttataaacaacgcctttagtattcgacagaatgacagtacggcctcaaaccctacctacaacgccctggcgtttatgcctaacagtaccatatatgcaagagggggaggtggtgaaccacgaaacaactactacgtccaaacgtatcttaggggaaatgttcaaaaaccaatcattcttactgtaacctacaactcagccgccacaggatattccttatcttttaagtggactgctcttgcacgtgaaaagtttgcaaccccaacaacttcgttttgctacattacagaacaataaaaccgtgtaccccaccgtttcgtttttttcagatgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacagttaaactaggaaacggcctcactctagacaaccagggacaactaacatcaaccgctggggaagtagaacctccactcactaacgctaacaacaaacttgcactggtctatagcgatcctttagcagtaaagcgcaacagcctaaccttatcgcacaccgctccccttgttattgctgataactctttagcattgcaagtttcagagcctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatagtggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcaatggaaacatagctgtttctcctcaagttacatcgcctgacaccttatggaccactgccgatccatcccccaattgttccatctacactgatttagatgccaaaatgtggctctcgttggtaaaacaagggggtgtggttcacggttctgttgctttaaaagcattgaaaggaaccctattgagtcctacggaaagtgccattgttattatactacattttgacaattatggagtgcgaattctcaattatcccactttgggcactcaaggcacgttgggaaataatgcaacttggggttataggcagggagaatctgcagacactaatgtactcaatgcactagcatttatgcccagttcaaaaaggtacccaagagggcgtggaagcgaagttcagaatcaaactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataaaacaacttttcctttttattttctttttattttacacgcacagtaaggcttcctccacccttccatttgacagcatacaccagcctctcccccttcatggcagtaaactgctgcgagccagtccggtatttgggagttaagatccaaacagtctctttggtaatcagatgtcgatccgtgatggacacaaatccctggggcaggttctccaacgtttcggtgaaaaactgcatgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagctctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctatgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagtgggaatatccaacgacagctgcaaagacagcaaaataatccctctgggagcaagcacaaaatcctccggtgaaaaaagaacatacatattagaataaccctgttgctggggcaaaaaggcccgacgtcccagcaaatgcacatatatgtgttgatcagccattgccccgtcttaccgcgtataaagccacgaaaaagtcgagctaaaatccacccaacagcctatagctatatatacactccgcccaatgacgctaacaccgtaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccgcgtcaccgcacgtcaccccggccccgcctcgctcctccccgctcattatcatattggcacgtttccagaataaggtatattattgatgatg

SEQ ID NO: 4 - DNA, 35094 bp, Rhesus Adenovirus 4305 (RhAd4305 / RhAd57) Wild Type
catcatcaataatataccttattctggaaacgtgccaatatgataatgagcggggaggagcgaggcggggccggggtgacgtgcggtgacgcggggtgacgcggggtggcgcgagggcggggcgggtgtgcggaggcgcttagtttttacgtatgcggaaggaggttttataccggaagttgggtaatttgggcgtatacttgtaagttttgtgtagtttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggttcccgagatgtacggtgttttctgcagcgagacggcccggaactcagatgagctgctgaattcagacctgctggaaatttcgaattcgcctgtgcttttgccgccgtcacttcacgacctgtttgatgtggaagtggaccctccggaagatcccaacgaggacgcggtaaatactatgtttccagaatgtctgtttgaggcggctgaggagggttcttacagcggtgaagacggcgggcagggagaggaagtggacctgaagtgctacgaggaatgtctaccttctagcgattctgaaacggaacagacagggggagatggctgtgctgaacctgttgtgaaaaatgaacttgtattagactgtcctgataatcctggtcacggttgccgcgcctgtgattttcatagaaatgccagtggaaatcctgagactctatgtgctctgtgttacctgcgccttaccagccattgtgtatacagtaagtagaaactttttcgctttgtgcatgctggtgggatttttaaagtgcgttgggcttattgttgcgtaatgttttacaggcgacgtgtctgacgcggaaggggatggagatagatcaggctctgctggttctccttgcactttgggggctgtggttccagatggcattattaaacccgtggcggtaagagtttcaggcagacggtgtgcggtcgaaaaaattgaagacttgctgcaggaggaacagatgcaacctttggacctgtccctgaaacgccctaagctgacctaagagtgtttattgtatgcaataaaaagtgttgatctttgaactgtgtttatgtgttgggtgtgtctgtgggtatataagcaggtggatgggaagtgagagcacagctgcttcagatggatctgctaggagacctgagggaatttggcgtggttcggcgcttgctggagttggcctctgacagaacttccaagttttggaggttttgttttggctcaacgcttagcaacgtgctatatagggtcaagaaggagcaggagacgcagtttgctaggctgttggccgatactcctggagtttttgtggctctggatctaggccatcactctcttttccaagagaaaattatcaaaaacttaacttttacgtctcctggtcgcacggttgcttccgctgcctttattacctatattttggatcaatggagcaacagcggcagtcacctgtcgtgggagtacatgctggattacatgtcgatggcgctgtggagggccatgctgcggaggagggtttgcatttacttgcgggcgcagcctccgcggctggaccgagtggaggaggaggacgagccgggggagaccgagaacctgagggccgggctggaccctccaacggaggactaggtgctgaggatgatcccgaagaggggactagtggggctaggaagaagcaaaagactgagtctgaacctcgaaactttttgaatgagttgactgtgagtttgatgaatcgtcagcgtccggagacaattttctggtctgaattggaggaggaattcaggaggggggaactgaacctgctatacaagtatgggtttgaacagttgaaaactcactggttggagccgtgggaggattttgaaaccgccttggacacttttgctaaagtggctctgcgaccggataaggtttacactatccgccgcactgttaacataaagaagagtgtttatgttataggccatggagctctggtgcaggtgcaaaccgccgaccgggtggcctttagttgcggcatgcaaaatctgggccccggggtgataggcttaaatggtgtaacatttcacaatgtaaggtttactggtgaaagttttaacggctctgtgtttgcaaataacacacagctgacgctccacggcgtttacttttttaactttaataacacatgtgtggagtcgtggggcagggtgtctttgaggggctgctgttttcacggctgctggaaggcggtggtgggaagacttaaaagtgtaacatctgtaaaaaaatgcgtgtttgagcgctgtgtgttggctttaaccgtggagggctgtggacgcattaggaataatgcagcgtctgagaatggatgtttccttttgctaaaaggcacggctagcgttaagcataacatgatatgcggcagcggtttgtacccttcgcagctgttaacttgcgcggatggaaactgtcagaccctgcgcaccgtgcacatagcgtcccaccagcgacgcgcctggccaacattcgagcacaatatgcttatgcgctgtgccgttcacctgggccctaggcgaggcgtgtttgtgccttaccagtgtaactttagccataccaagtttttactagaacctgacaccttctctcgagtgtgtttcaacggggtttttgacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatttcggcgctcaagttgtcagtttctacaaacgaggaggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggatttaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggctccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggccgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcaccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgcgccaggtgcagatggtacttgatttccaggggggtgttggaagaggcgtccacggcgtagaggaggccgtgtccgcgcggggccaccaccgtgccccgaggaggttttacctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcctgataggcgatctcggccatgaactgctccacttcttcctcgcggaggtcgccgtgacccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagtacggcctgttgaatctgcgtgagggtggtctggaagtcgtccaggtccacgaagcggtgataggcccccgtgttgatggtgtaggtgcagttggccatgacggaccagttgacgacttgcatgccgggttgggtgatctccgtgtacttgaggcgcgagtaggcgcgggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgtcgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgggagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcaacacagccgcgacaacgagacgttccgcgacgccatgttgaacatcgcggagcccgagggtcgctggctcttggacctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacacacgagaaagtcctgactatcgtgaacgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaacttgcaaggcatgtggggcgtcaaggccccggtgggcgatcgagccaccatctccagtctgctgacccccaacactcgcctgctgctgctcttgatcgcgccgttcaccaacagtagcactatcagccgtgactcgtacctgggtcatctcatcactctgtaccgcgaggccatcggtcaggctcagatcgacgagcatacatatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgcgtccgatagcattttcacgccggctaatcgccgattccagaagaaggagggcggagacgagctccccctctccagcgtggaggccgcctctaggggagagagcccctttcccagtctgtcttccgccagtagcggtcgggtcacgcgcccgcggttgccgggggagagcgactacctgaacgaccccttgctgcgaccggctaggaagaaaaatttccccaacaacggggtggaaagcttggtggataaaatgaatcgttggaagacctacgcccaggagcagagggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaagggcgttcgagtcgcctgtactaataaaaaagaagcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggattagaaagcgccgccccttccaagagggctttcagatcatgtatgaggacctggagggaggtaatatacccgccctactggacgtgtcaaagtatgaggacagcgtgaagaaggcggaagctcagggacgagaaattcggggcgacacatttgcggtggcaccccaagacctggtgatagagcctttgactaaagacagcaaaaacagaagctacaacattattaccggtactatggacaccaaatatcggagctggtttctggcttacaactacggggatcccgaaaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtctaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgccagcatggccagacccaggagagggaacgtgtactgggtgcgcgattctgtgacgggagtccgcgtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcagacctattaaggaagtggcccccggtcttggggtgcaaacggtggacattcaaatccccgtcaccaccgcttcaaccgccgtggaagccatggaaacgcaaacggaaacccctgccgcgatcggtaccagggaagtggcgttgcaaacggagccttggtacgaatacgcagcccctcggcgtcagaggcgttccgctcgttacggtcccgccaacgccatcatgccagaatatgcactgcatccgtctatcctgcccactcccggataccggggtgtgacgtatcgcccgtctggaacccgccgccgaacccgtcgccgccgccgctcccgtcgcgctctggcccccgtgtcggtgcggcgtgtgacccgccggggaaagacagtcgtcattcccaacccgcgttaccaccctagcatcctttaataactctgccgttttgcagatggctctgacttgccgcgtgcgccttcccgttccgcactatcgaggaagatctcgtcgtaggagaggcatgacgggcagtggtcgccggcgggctttgcgcaggcgcatgaaaggcggaattttacccgccctgatacccataattgccgccgccatcggtgccatacccggcgttgcttcagtggccttgcaagcagctcgtaataaataaacgaaggcttttgcacttatgacctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaactttcaagaaaaagtggtcaatggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggggagcaaggagcctccctcgtacgagcaagccttgaaagagggcgcctctccaccctcctacccgatgactaagccgatcgcacccatggctcgaccggtgtacggcaaggattacaagcccgtcacgctagagctccccccgccgccaccgccgccccccacgcgcccgaccgttccttccctgccggctccgtcggcggccgcggcgggacccgtgtccgcacccgtcgccgtgcctctgccagacgcccgcccagtggccgtggccgctgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccccaccgtggcccccacccacgatgtaaccacggaccgctcgcagaggctgaccctgcgctttgtgcccgtagaccgggaggacaccgcgtactcttacaaagtgcgctacacgctggccgtaggggacaaccgagtgctggacatggccagcacctacttcgacatccggggggtattggatcgcggtcccagtttcaagccctactccggcaccgcttacaactccttggcccccaagggcgcccctaacccttcagaatgggaagggtcagacaacaaaacacacgttagaggtcaagcgccctttattagcgatgaaattacaaaggagggcataaaagtaggcactgatactggaaaccccggacaggcaatttatgctaaaaaagcttaccagccggaaccccaggtgggagaaacacaatggaacagcgacgtgggaacaaacgacaaagcggcaggacgaattttaaagaaaacaacacccatggttccgtgctacgggtcttacgccaagcccacaaacgaagaaggggggcaggctacaaaccaacaagtagatttgcagtttttctcaacgggtagctccaatacaactcccaaagttgtgctgtattccgaagacgtttctcttgaaacgccagacacccacctggtgtttaaaccaacagttactgcgggcgtcacaaatgcagaagctttgttagcgcagcaagctgctccgaatcgtccaaactacattgcattcagagataacttcattggacttatgtactacaacagtacaggaaatatgggagtgctggccggtcaggcttcgcagttgaacgctgtagtggatttgcaagacagaaacactgaactgtcatatcagctaatgttggatgctttaggtgacagaagcaggtacttttcaatgtggaatcaagccgtggacagttatgaccctgatgtaagaattgtggaaaatcatggagtagaagacgaattacccaactattgttttccgctggggggcatggcagtcaccgatacctactcaggcataaaaccttcagataacggaggtacatttcaggcagataacactgttgcagatagagtagaaataggttcaggaaacatgttcgccatggaaatcaatttgcaagccaacctgtggcggggtttcttatactccaatatcggactgtacctcccagacacgctaaaactcacccccgacaacatcacgctcccagagaacaaaaacacctaccagtatatgaacggtcgagtcacgccccccgggctcgtggacacctacgttaacgtgggcgcgcgctggtcccccgatgtcatggacagtattaacccttttaatcaccaccgcaacgccggactccgctaccgttccatgctcctgggaaacggacgctacgtgcccttccacattcaggtgccccagaaattctttgcaattaaaaacctgctgctgctccccggttcctatacctacgagtggaacttccgcaaggacgtgaacatgattttgcaaagctcgctgggtaacgacctgcgagttgacggggccagcatacgcttcgacagcatcaacctgtatgctaactttttccccatggcccacaacacggcctccaccctggaagccatgctgcgcaacgacaccaacgaccaatcttttaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggaaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtgatgtggaggatccccttctctagcaactttatgtcgatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcctaacagcatgcttcacagcccccaggtcgcccccaccctgcgccgtaaccaggaacacctgtatcgctttttggggaaacactctgcctactttcgccgccaccggcagcgcattgaacaggccacagcctttgaaagcatgaaccaaagagtgtaatcaataaaaaaaccattttattttaacatgacacgcgcttctggcgttttttattaaaaatcgaagggttcgagggaggtgtcttcgtgcccgctggggagggacacgttgcggtactggaaacgggcgctccaacgaaactcggggatcaccagccgcggcagaggcacgtcttccaggttctgcttccaaaactgccgcaccagctgcagggctcccatcacgtcgggcgccgatatcttgaagtcgcagttagggccggagctcccgcggctgttgcggaacacggggttggcacactggaacaccagcacgccggggttgtggatactggccagggccgtcgggtcggtcacctccgacgcatccagatcctcggcgttgctcagggcaaacggggtcagcttgcacatctgccgcccaatctggggtacgaggtcgcgcttgttgaggcagtcgcagcgcagagggatcaggatgcgtcgctgcccgcgttgcatgatagggtaactcgccgccaggaactcctccatttgacggaaggccatctgggctttgccgccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgtccgttctcgctggttacatccatttccaacacgtgctccttgcagaccatctccactccgtggaagcagaacaggacgccctcctgctgggtactgcgatgctcccatacggcgcatccggtgggctcccagctcttgtgttttacccccgcgtaggcttccatgtaagccatgaggaatctgcccatcagctcggtgaaggtcttctgattggtgaaggtcagcggcaggccgcggtgctcctcgtttaaccaagtttgacagatcttgcggtacacggctccctggtcgggcagaaacttaaaagcccctctgctctcgttgtccacgtggaacttctccatcaacatcaccatgacttccatgcccttctcccaggcagtcaccagcggcgcgctctcggggttcttcaccaacacggcggtagaggggccctcgccggccccgacgtccttcatggtcattctttgaaactccacggagccgtccgcgcgacgtactctgcgcaccggagggtagctgaagcccacctccaccacggtgccttcgccctcgctgtcggagacaatctccggggatggcggcggcgcgggtgtcgccttgcgagccttcttcttgggagggagcggaggcacctcctgctcgcgctcggggctcatctcccgcaagtagggggtaatggagcttccgggttgattctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcggccgataggaagctgacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccgcccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtttcctacatgggcatcctccacgagaaccggctggggcagagcgtgctgcactgcaccttgcagggcgaggcgcggcgggactacgtccgcgactgcgtctacctcttcctcacccttacctggcagaccgccatgggcgtctggcagcagtgcttggaagagagaaacctcaaagagcttgacaaactcctctgccgccagcggagggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctccttcgtcctggagcgctccgggatcttacccgccatgagctgcgcgctaccttctgactttgtccccctttcctaccgcgagtgccctcccccactgtggagccactgctacctcttccaactggccaactttctggcctaccactccgacctcatggaagacgtaagcggagaggggctgctggagtgccactgccgctgcaacctctgcaccccccacagatccctggcctgcaacaccgagctgctcagcgagacccaggtcataggtaccttcgagatccagggaccccaacagcaagagggtgcttccggcttgaagctcactccggcgctgtggacctcggcttacttacgcaaatttgtagccgaggactaccacgcccacaaaattcagttttacgaaaaccaatctcgaccaccgaaagcccccctcacggcctgcgtcatcacccagagcaagatcctggcccaattgcaatccatcaaccaagcgcgtcgagatttccttttgaaaaagggtcggggggtgtacctagacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcatcgtcagcatgagcaaggagattcccaccccctacatgtggagctatcagccgcagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcgcctggacgctacccggacgccttcattcccaactttgacgcagtgagtgaatccgtggacggctacgactgatgacagatggtgcggccgtgagagctcggttgcgacatctgcatcactgccgtcagcctcgctgctacgctcgggagccgatcgtcttcagctactttgagctgccggacgagcaccctcagggaccggctcacgggttgaaactcgagatcgagaacgcgctcgagtctcgcctcatcgacgccttcaccgcccgacctctcctggtagaaaccgaacgcgggatcactaccatcaccctgttctgcatctgccccacgcccggattacatgaagatctgtgctgtcatctttgcgctcagtttaataaaaactgaactttttgccgcaccttcaacgccatctgtgatttctacaacaaaaagttcttctggcaaaggtacacaaactgtattttattctaattctacctcatctatcgtgctgaactgcgcctgcactaacgaacttatccagtggattgcaaacggtagtgtgtgcaagtacttttgggggaacgagatagttagtagaaataacagcctttgcgagcactgcaactcctccacactaatcctttatcccccatttgttactggatggtatatgtgcgttggctccggtttaaatcctagttgctttcataagtggtttctacaaaaagagacccttcccaacaattctgtttcttttttcaccctgtcctactgctgctctccctctggttactctttcaaacctttaattggtattttagctttgatactgataatctttattaactttataataattaacaacttacactaaacatgcttgctattctgctcttcactctagcgctcacttactctaatgcaagaacacttttctgcggcgctggctacaatgcaactcttcaaaccgcttacatgccagatcccgaccaaataccccgtattacatggtacatacagacctccacgcctaactcctcattttatgaaggtcaaaaactctgcgacgtctccgacaacaagtcgcacacatttccccacgcttacctacaatttgattgtgtaaacaaaagcctaagactttacaacttaaaacctaaggattctggtttataccatgctgtagttcaaaaaaatgagctagaccaacatatggattattttcaggtgacagttgtggaattaccgccgccaaaatgcgaagtttcctcttcttaccttgaggttcaaggcgtagagtcctactgccttatacacatcaattgtagcaactccaaatacccagctagaatttactttaatggtcaggaaagtaatttttttcactatttaacaacaagcggcggtacgaagcctttacctgactatttcacaacagttgttgaattttccacctacaaagaaacgtatgcaaaacgatcttacaatttttcatacccatttaacgacctttgtaatgaaatacaagcgcttgaaactggaactgattttactccaattttcattgctgccattgttgtgagctttattacaattactattagcctcacattttgctgcttctacaaacgcaaaaaacctaagtttgaaaaacttaagctaaaacctgtcattcaacaagtgtgattttgttttccagcatggtagccgcatttctacttctcctctgtctacccatcattttcgtctcttcaactttcgccgcagtttcccacctggaaccagagtgcctaccgccttttgacgtgtatctgattctcacctttgtttgttgtatatccatttgcagtatagcctgcttttttataactatctttcaagccgccgactatttttacgtgcgttttgcttactttagacaccatcctgaatacagaaatcaaaacgttgcctctttactttgtttagcatgattaaattattgctgttacttaactatttacccctaattaattgtaattgtccattcaccaaaccctggtcattctacacctgttatgataaaatccccgacactcctgttgcttggctttacgcagccaccgccgctttggtatttgtatctacttgccttggagtaaaattgtattttattctacacactgggtggctacatccccgagaagatttacctagatatcctcttgtaaacgcttttcaattgcagcctctgcctcctcctgatcttcttcctcgagctccctctgttgtgagctactttcaactcaccggtggagatgactgactctcaggacattaatattagtgtggaaagaatagctgctcagcgtcagcgagaaactcgagtgatggagtaccttgaactacagcagcttaaggagtcccactggtgtgagaaaggagtgctgtgccatgttaagcaggcggccctttcttacgatgtcagcctccagggacatgaactgtcttacactttgccttcgcaaaaacaaaccttctgcaccatgatgggtcctacctctatcacaatcacccaacaaaccggacctgtcgagggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagtccgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacagggataaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctaagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcaggtaacaaacaatagcctcgctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttgacagcgagccccaactgggcgtacactttaatccccctatcaccgtgcaacaaggaggtctggccttaaatacaggggatggtttgcaagtatatcttaacaaactaacgctaaacataggcagagacttgcaatatgaaaacggctcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgaatcagtccggtatttgggagttaagatccaaacagtctctttggtgatgaaacgtggatccgtgatggacacaaatccctgggacaggttctccaacgtttcggtaaaaaactgcgtgccaccctacaaaacaaacaggttcaggctctccacgggttatctccccgatcaaactcatacagggtaaaggtgcgatgatgttccactaaaccacgcaggtggcgctgtctgaacctctcggtgcgactcctgtgaggctggtaagaagttagattgtccagcagcctcacagcacgtatcatcagtctacgagtacgtctggcgcagcagcgcatttgaatctcactgagatttcggcaagaatcgcacaccatcacaatcaggttgttcataatcccatagctgaacacgctccagccaaagctcattcgctccaacagcgccaccgcgtgtccgtccaaccttactttaacataaatcaggtgtctgccgcgtacaaacatactacccgcatacagaacttcccggggcaaacccctgttcaccacctgcctgtaccagggaaacctcacatttatcagggagccatagatagccattttaaaccaattagctaacaccgccccaccagctctacactgaagagaaccgggagagttacaatgacagtgaataatccatctctcatagcccctgattacctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccggcgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcaatgcacacctcaaacctacagatgtctcggtacagttccaaacacgtagtgagggcgagttccaaccaagacagacaggctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccactgccaaagttcacccacacccacgaaacccgcgaaaatccagcgccgtcagcacttccgcaatttcagtctcacaacgtcacttccgcgcgccttttcacattcccacacccgcccacaaaccccgccctcgcgccaccccgcgtcaccccgcgtcaccgcacgtcaccccggccccgcctcgctcctccccgctcattatcatattggcacgtttccagaataaggtatattattgatgatg

SEQ ID NO: 5 - DNA, 34364 bp, Rhesus Adenovirus 4308 (RhAd4308 / RhAd58) Wild Type
catcatcaataatataccttattctggaagcgtgccaatatgataatgagcggggaggagcgaggcggggccggggtggggtgagggtgacgcgcggggcgggacggggcgaaggttgcgggcggggcggcggacgtgtgtggggaggcgcggaaagtttacgtaagcggaagtaggttttttaccggaagatgggtaatttgggcgtaatcttgtaacttttgtgtgatttggcgcgaaaactgggtaatgaggaagttgaggttaatatgtactttttatgactgggcggaatttttgcggatcagcactgaactttgggcgctgacgaggaggtttcgctacgtggcagtaccacgagaaggctcaaaggtcccatttattgtgctcctcagcgttttcgctgggtatttaaacgcgctcagatcatcaagaggccactcttgagtgccggcgagtagagttttctcctccgactgccgcgatgaggctggttactgagatgttcgatgtcttttatgacgagatggcgcgaaactccgatgagctgctgaactcagacctgctggatgttcctggcacacctgtgctgtctccgccatcgctgcacgatttgttcgatgtggaagtggacccaccggaagaccctaacgaggacgcggtaaatactctgtttccagattttatgcttgaggcggctgaggagggttcccacagcggtggagagagcggacggtcgggtgatgaactggacttaaaatgttacgaggaatgcctaccttctagcgagtctgagtctgatgaagcggacggttgtgctgaacaaactgtgaaaaatgaacttatattagactgtcctgaacatcctggtcatgactgccgtgcctgtgatttccataggagcgctagcggaaatcctgagactttatgtgctctgtgttacttgcgcctcaccagtgattttgtatacagtaagtagacattttattttttgctgcacatgttgggaggtaaatgggcagcggcttattgttttgtgtgctttatttacaggcgatgtgtccgatgtggacgaaggagacagatcgggggctgctaattctccttgcactttgggagctgtggttccagttggtgttcttaagcccgtggcggtcagggtatcaggtagacggcgagcagttgaaagaattgaagacttgctgcaggaagaacaggagggacctttggacctgtccttaaaacgccctaagatgacttaagcttgtttattgtatgcaataaagtgttgatctttgaacagtgtttatgtgttgggtgtgtctgtgggtatataagcaggtggatttgggagagagtacagctgtcttccgatggatctgttgaaagagctgagggattttgacgttgttcgccagttgctggagtcggcgtctgacaaaacttccaagttttggaggttttgttttggctcgacccttagcaacgtggtgtacagggtaaaaaaggagcaagctgaacagttttctaggctgttggctgaaatccccggagtttttgttgctctggatttaggccaccacgctctttttcaagaaaaagttattaaaagcttaactttttcttcacctggtcgcgtggttacctctttggcttttatctgccaccttttggataaatggagcagcgacagccacctgtcatggaattacatgctggattacctgtcgatggcggtgtggagggccatgctgaggaagagggtctgcatatacttgcgggcgcagcctccgcggttggatcgagtggaggaggaggacgagccggtggaaaccgacaatccgagagccggcctggaccctccagtggaagactaggtgctgagggcgatcctgaggagggaactagtgggggcgctaggaaaaaacaaaagactgactctgaacctaaaaactttttaactgagttaactgtgagtttgatgaaccgcagccgtcctgaaacaatttactggtctgagttggaagatgagttcaaaaggggggaattgaatctgctgtacaagtatgggtttgagcagttaaagacacactggttggagccgtgggaggattgggaaaccgccttggacactttcgctaaagtggctttgcggcctgacaaggtttacactatacgccagcctgttaacataagaaagagtgtttatgttataggccatggagctctggtgcaggtgcaaaccactgagcgggtggctttcaattgcggtatgcagagtctgggccccggagtaataggcttaaatggtgtaacatttcacaatgtgaggtttgtgggagaaaattttgccggctctgtgtttgtaactaacacacagctcactcttcacggcgttcacttttttaatttcaacaatacgtgcgtggagtgttggggcagggtgtctttaaggggatgcagttttcacgggtgctggaaggcggcggtgggaagaatcaaaagtgtgatgtctgtgaaaaaatgcatttttgagcgctgtgtaatggctttaacggtggagggttatgctcgcatcaggaataacgcggggtcagacaatggatgttttcttttgctaaaaggcacggctagcgttcgacataatatgatatgcggtagtggcttgtgcccttcgcagctgttgacctgcgcagatgggaactgccataccttgcgcaccgtgcacatagtttcccacccacgccgagcctggccaacgtttgagcataatatgctgatgcgttgtgccgttcaccttggctctagacgtggtgtgtttatgccttatcaaactaactttagtcataccaagattttgctggagactgacacttttcctagagtatgtttcaatggggtgtttgacgtgtcagtggaaatttttaaagtgataagatatgatgaatgcaagtctcgttgtcgcccctgtgagtgtggagctaaccatatgaggttgtatcctgtaactctgaacgtcacggaagagctgagacctgatcatcacatgttgtcttgcttgcgcaccgactacgaatccagcgatgaggagtaaggtgaggggcggagttaaaaggggtataaataaacagggtgggcagacccctatattcaaaatgagcggcacaacagacggtaacgcgtttgaggggggagtattcagcccatatttgacatctcgtcttccttcctgggcaggagtgcgtcagaatgtagtgggctctaccgtggacggacggccggtcgcccctgcgaattccgccaccctcacctatgctaccgtgggatcatcgttggacactgccgcggcagctgctgcttctgctgccgcttctactgctcgtggcatggcggctgattttggactgtataaccaactggccactgcagctgtggcgtctcgctctctggtgcaagaagatgccctgaatgtgattctgactcgtctggagataatgtctcgtcgcttggacgaactggccgcgcaaatttcccaatccaatcccgaatcaacttcagaataaataaagacaaacagatttgatgaaataatggtgttttatttgttttttttggctcggtaggctcgggtccacctgtcccggtcgttaaggactttgtgtatattttccaagacccggtacagatgggcttggatgtttagatacatgggcatgaggccatctcgggggtggagataggaccattgcagagcgtcatgctccggggtggtgttgtagatgacccagtcgtagcagggtttttgggcgtggaactggaaaatgtccttgagaagcaggctgatggccaggggcaaacccttagtgtaggtgttcacaaagcggttgagctgggagggatgcatgcggggagagatgatatgcattttagcctggattttcaggttagctatgttgccccccaggtcccttcgtgggttcatattgtggaggaccaccagaacggtgtagccggtacacttggggaacttatcgtggagtttggaggggaacgcgtgaaagaatttggaaacccccttgtgcccacctaagttttccatgcactcatccatgataatggctatgggtcccctggcggccgctttggcaaacacattgtgggggttggaaacatcatagttttgctctagagttagctcatcataggccatttttacgaagcggggtagcagggtgccagactgagggacgatggttccatctggccccggggcgtaattaccctcacagatctgcatttcccaagctttaatttctgagggagggatcatgtccacctggggggcgatgaaaaacacggtttctggcgggggattgatgagctgggtggaaagcaggttgcgcaagagctgagacttgccgcaaccggtgggaccgtagatgaccccgatgacgggctgcagctggtaattgagagaggagcagctgccgtcggggcgtaggaggggagccacctcgttcatcatgcttcttacatgtttattttcactgactaagctttgcaagagcctctccccacccagggacaagagttcttccaggctgttaaagtgtttcagcggtttcaggccgtcggccatgggcatcttttcaagcgactgacgaagcaagtacaggcggtcccagagctcggtgacgtgctctatggaatctcgatccagcagacttcttggttgcgggggttgggccgactttcgctgtagggtacgagccggtgggcgtccagggccgccagggttctgtccttccagggtctcagcgtccgggttagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtaactgagggcctcggccgcgtgtcccttggcgcgcagctttcccttggaaacgtgctgacatttggtgcagtgcagacacttgagggcgtagagtttgggggccaggaaaacggactcgggtgagtaggcgtcggctccgcactgagcgcagacggtctcgcactccaccagccacgtgagctcgggtttagcgggattaaaaaccaagttgcctccattttttttgatgcgtttcttaccttgcgtctccataagtctgtgacccgcttccgtgacaaaaaggctgtcggtgtccccgtagaccgacttgatggggcgatcttccaagggcgttccgaggtcttccgcgtacaggaactgggaccactccgagacgaaggctctggtccacgctaacacgaaggaggcgatctgcgaggggtatctgtcgttttcaatgagggggtccaccttttccagggtgtgcagacagaggtcgtcctcctcggcatccacaaaggtgattggtttgtaagtgtaggtcacgtgaccggcaccccccgaaggggtataaaagggggcgtgcccaccctccccgtcactttcttccgcatcgctgtggaccagagccagctgttcgggtgagtaggccctctcaaaagccggcatgacttcggcactcaagttgtcagtttctacaaacgaggaggatttgatgttcacgtgccccgctgcgatgcttttgatagtggaggggtccatctggtcagaaaacacgatctttttgttgtcaagtttggtggcaaaagacccatagagggcgttggaaagcaacttggcgatggagcgcagggtctgatttttttcccgatcggccctctccttcgcggcgatgtttaattgcacatactcgcgggccacgcatcgccattccgggaacacggcggtgcgctcgtcggggaggatgcgcacgcgccagccgcggttgtgtagggtgatcaggtccacgctggtggccacctctcccctgaggggctcgttggtccaacacaatctccctccttttctggagcagaacggagggaggggatctaggaggttggggtgcggggggtcggcgtcgatggtgaagatgccgggcaggagcactttattaaagtaatcgatctcggtctccacgtcttgcaacgcttcctcccatctctttaccgccagggccctctcgtatggattcaggggcgccccccagggcatggggtgggtgagagccgaggcgtacatgccacagatgtcatacacgtacaggggctcccgtaggaccccgatgtaagtgggataacagcgccccccgcggatgctggcccgcacgtagtcgtacatctcgtgagacggggcgaggagaccctctcccaagtgggtcttgtggggcttctccgcccggtagaggatctgtctgaagatggcgtgggagttggaagagatggtaggccgttggaagacgttaaagttggcccgtggcagccccaccgagtcttcgatgaactgggcgtaggattcctggagtttgttcacgagggcggcggtgaccagcacgtccagggcgcagtagtccagggtctcgcggaccaggttgtaggagctctcttgttttttctcccacagttcgcggttgaggaggtattcctcgcggtctttccagtactcttcggcgggaaatcctttttcgtccgctcggtaagaacctaacatgtaaaactcgttcaccgctttgtatggacaacagcctttctctaccggcagggcgtacgcctgagcggcctttctgagagaagtgtgggtgagggcgaaggtgtcccgcaccatgactttcaggtactgatgcttgaagtccgtgtcgtcgcagcttccttgttcccacaagctgaagtcggtgcgctttttctgcctcgggttggggagggcgaaagtgacatcgttaaacaagattttcccggcgcggggcatgaagttgcgagagatcctgaagggcccgggcacgtccgagcggttgttgatgacctgcgccgccaggacgatctcgtcgaagccgttgatgttatgccccacgatgtagagttctatgaagcgcggctgtcccttgagggcgggcgcttttttcagttcctcgtaggtgagggattcgggagaggcgagccccagctccgcgcgggcccagtcggccagttgagggttagccgcgaggaaggaattccagagctccgaggccagaagagtttgcaggcggtcgcgaaactcgcggaactttttccccacggccattttttctggcgtgaccacgtagaaagtggcggagcggtcgttccagacgtcccacttgagctcccgggccagctcgcaagcctgacgcacgagagtttcctcgcccgaaacgtgcatgaccaacatgaaaggcactaactgttttccgaacgcgcccatccacgtgtaggtttctacatcgtaggtgacaaagagccgttgggtgcgtgcgtgggagccgatcggaaagaagctgatctcctgccaccagctggaggaatgggtgttgatgtggtgaaagtagaagtcccgccggcgcacagagcattcgtgctggtgtttgtaaaagcgaccgcagtagtcgcagcgctgcacgctctgtatctcttgaatgagatgcacttttcgcccgcgaaccagaaatcggaggggaaagttgagcccgggggatggtggagtcgcgtccccttcgccttggcggtgggcgtctgcgtctgcggcctgtttttctgggtggacgacggtggggacgacgacgccccgggttccgcaagtccagatttcagcgacggaggggcgcagacgctgaaggagggggcgcagttgcccgctgtccaaagagtcgaggaaagcgacgctgaggtcagcggggagcgtttgcaaattcactttcaagagaccggtaagagcgtgagtcaggtggagatggtacttgatttccaagggggtgttggcagaggcgtccacggcgtacaagagaccgtgtccgcgcggcgccaccacggttccccgcggaggttttatctcactcgtcgagggcgagcgccggggggtagaggcggctctgcgccgggaggtagcggaggcagaggcacgttttcgtgaggattcggcagcggctgatgacgtgcccggagactgctggcgtgggcgacgacgcggcggttgaggtcctggatgtgctgcctctgcgtgaagaccaccggccccctggtcctgaacctgaaagagagttccacagagtcaatgtctgcatcgttaacggccgcctgcctgaggatctcctgcacgtcgcccgagttgtcttggtaggcgatctcggccatgaactgttcgacttcttcttcgcggaggtcgccgtggcccgcgcgttctaccgtggcggccaggtcgttagagatgcgacgcatgagttgggagaaggcgttgaggccgttctcgttccacacgcggctgtacaccacgttaccgaaggagtcgcgcgctcgcatgaccacctgcgccacgttgagttccacgtggcgggcgaagacggcgtagtttctgaggcgctggaagaggtagttgagcgtggtggcgatgtgctcgcagacgaagaagtacatgatccagcgccgtagggtcatttcgttgatgtctccgatggcttcgagacgttccatggcctcgtagaagtcgacggcgaagttgaaaaattgggagttgcgggcggccaccgtgagttcttcttgcaggaggcggatgagatcggcgacggtgtcgcgcacctcctgttcgaaagcgccccgaggcgcctctgcttcttcctccagctcctcctcttccaagggcacaggttcctccggcacctctgcggcggggacggggcggcgacgtcgtcgtctgaccggcagtcggtccacgaagcgttcgatcatttcaccgcgccggcggcgcatggtctcggtgacggcgcgtccgttttcgcgaggacgcagttcgaagacgccgccgcgcagagcgcccccgtgcagggagggtaagtggttagggccgtcgggcagggacacggcgctgacgatgcattttatcaattgttgcgtaggcactccgtgcagggatctgagaacttcgaggtcgacgggatccgaaaacttctctaggaaagcgtctatccaatcgcaatcgcaaggtaagctgaggacggtggggcgctggggggcgtccgcgggtagttgggaggtgatgctgctgatgatgtaattaaagtaggcggtcttcaggcggcggatggtggcgaggaggaccacgtctttgggcccggcctgttgaatgcgcaggcgctcggccatcccccaggcctcgctctgacagcgacgcaggtctttgtagtagtcttgcatcagtctctccaccggaatctctgcttctcccctgtctgccatgcgagtcgagccgtacccccgcaagggctgcagcaacgctaggtctgccactactctttcggccagcacggcctgttgaatctgcgtgagggtggtctggaagtcgtccatatccacgaagcggtggtaggctcccgtgttaatggtgtaggtgcagttggccatgacggaccagttgacgacttgcatgccgggttgggtgatctccgtgtacttgaggcgcgagtaggccctggactcgaacacgtagtcgttgcatgcgcgcaccagatactggtagccgacgagaaagtggggaggcggttcccgatacaggggccagcccacggtggcgggggctccgggggccaggtcttccagcatgaggcggtggtagtggtacacgtatcgagagagccaggtgatgccggctgaggtggtggcggccctggtgaactcgcggacgcggttccagatgttgcgcagggggcggaagcgttccatggtgggcacgctctgtcccgtcaggcgcgcgcaatcctgtacgctctagatggaaaaaagacagggcggtcatcgactcccgtccgtagctgggaggtaaagtcgcaagggtgcagcggcggggaaccccggttcgagaccggccggatccgccgttcccgatgcgcctggccccgcatccacgacgttcgcgccgagacccagccgcggcacaccgccccaatacggaggggagtctttttggtgtttttttcatagatgcatccggtgctgcgacagatgcgaccccagacgcccgctgctactaccgccgcggcggcagtaaacctgagcggaggcggtgacagggaggacgaagagctggctttagacctggaagagggagagggactggcgagactgggcgccccctcccccgagagacaccccagggtccagctcgtgagggacgcgagacaggcttttgtgccgcggcagaacctgttcagagaccgcagcggccaggaggcggaggagatgcgcgattgtcggtttcgggcgggcaaagagctgagggcggggtttgaccgggagcggttgctgcgggcggaggatttcgaacccgacgagcgttcgggggtgagtccggctcgagcccacgtgtcggcggccaacctggtgagcgcgtacgagcagactgtgaacgaggagcgtaacttccaaaagagctttaataatcacgtgcggacccttatcgcgagggaagaggtgaccatcgggctgatgcatctgtgggacttcgtggaggcctacgtgcagaacccggcgagcaagcccctgacggctcagctgttcctgatcgtgcagcacagtcgcgataacgagacgtttcgcgacgccatgcttaacatcgccgagcccgagggccgctggctcttggatctcatcaacatcttgcagagcatcgtggttcaggagaggggtctcagcttagcggacaaggtggcggccattaactactccatgcagagtctgggaaaattctacgctcgcaagatctacaagagcccctacgtgcccatagacaaggaggtgaagatagacagcttttacatgcgcatggcgctgaaggtgctgacgctgagcgacgatctcggcgtgtaccgtaacgacaagatccacaaggcggtgagcgccagccgccggcgggagctgagcgacagggagctgatgcacagcttgcagagggcgctggcgggcgccggggacgaggatcgcgaggcttacttcgatatgggagcggacttgcagtggaaacccagcgcccgcgcgctggaggcggcgggctaccccggcgatgaggatcgggatgactttgaggaggcaggcgagtacgaggacgaagcctgaccgggcaggtgttgttttagatgcagcgtccggcggacggggccaccgtggatcccgcgcttttggcatccatgcagagtcaacctactggcgtgaccgcctccgatgactgggcggcggccatggaccgcatcatggcgctgaccacccgcaaccccgaggcttttaggcagcagccccaggccaaccgtttttcggccatcttggaagcggtggtgccctcgcgcactaatcccacccacgaaaaggtcttaacgatcgtgaacgcgctggtagacagcaaggccatccgccgcgacgaggcggggctgatttacaacgctctgctggaacgcgtggcgcgctacaacagcactaacgtgcagaccaatctggaccgcctcaccacggacgtgaaggaagcgttggctcagaaggagcggttcttgagggacagcaatctgggttctctggtggcgctgaatgctttcctgagcacgcagccggcgaacgtaccccgcgggcaggaggactacgtgagcttcatcagcgctctgagactgctagtctccgaggtgccgcagagcgaggtgtaccagtcgggtccggattacttcttccagacgtcccgccagggcttgcaaacggtgaacctgactcaggcttttaaaaacttgcaaggcatgtggggcgtgaaggcgccggtcggcgatcgcgcgaccatttccagcctcctgacccccaacacgagactgctgttgcttttaatcgccccgttcaccaacagcagcaccatcagccgcgactcgtacctgggtcatctcatcactctgtaccgagaggccataggacaggctcagattgacgagcatacgtatcaagagatcactaacgtgagccgagccctgggtcaggaagacaccggcagtttggaagccacgctaaactttttgctgaccaatcggaggcaaaagattccctcccagtacacgttaagcgccgaggaagagaggatcctgcgctacgtgcagcagtccgtgagcctgtacttgatgcgggagggggctaccgcttccacggccttggacatgacggctcgaaacatggaaccgtccttttactcggcccaccgtccgttcatcaatcgcctgatggactacttccatcgcgcggccgccatgaacggggagtattttaccaatgccatcttgaatccgcattggatgcctccgtccggtttctataccggggagttcgacctgcccgaggccgacgacggctttctgtgggacgacgtgtccgacagcatcttcacgcccgggaacagccggttccacaaaaaggaaggaggagacgaacttcccctttcgagtgtggaggcggcctccaggggggagagcccctttcctagcttgtcttccgtcagcagcggccgggtgacacgcccacgcttgccgggggagagcgactacttaaacgaccctttgctgcgaccggctagaaagaaaaattttcccaacaacggggtggaaagcttggtggataaaatgaatcgttggaagacctacgcccaggagcagcgggagtgggaggacagtcagccgcggccgctggtcccgccgcattggcgtcgccagagagaagacccggacgactccgcagacgatagtagcgtgttggacctgggagggagcggagccaacccctttgctcacttgcaacccaaggggcgcttgagtcgcctgtactaataaaaagaaagcggaaacgtaccagagccatggccacagcgtgtgtcctttcttcctctctttcctcctcggcgcggcagaatgagaagagcggtgagagtcacgccggcggtgtatgccgagggtccgcccccctcttacgaaagcgtgatgggatcagcgaacgtgccggccacgctggaggcgccttacgttcctcccagatacctgggacctaccgagggcagaaacagcatccgttactccgagctggcccccctgtacgataccaccaaggtgtacctggtggacaacaagtcggcggacatcgcctccctgaattaccaaaacgaccacagcaacttcctgaccaccgtggtgcagaacaatgacttcaccccgacggaggcgggcacgcagaccattaactttgacgagcgttcccgctggggcggtcagctgaaaaccatcctgcataccaacatgcccaacattaacgagtttatgtccaccaacaagtttagggccaggctgatggtagagaagactaacgctgagactcagcagcctcgatacgagtggtttgagttcaccattcccgagggcaactactccgaaaccatgactatcgatctgatgaataatgccattgtagacaattacctgcaagtcgggaggcagaacggggtgctggagagtgatattggggtaaaatttgataccaggaacttccggctggggtgggatccggtcactaagctggtgatgccaggcgtgtacaccaacgaggcttttcaccccgatatcgtgctgctgcctgggtgcggagtggactttacgcagagccgcttgagtaacctgttaggaatcaggaagcgccgcccctttcaggagggctttcagatcatgtatgaggacttggaaggaggtaacattcccgccctgctggacgtctcgaagtatgaagctagcgtacaacgcgctgaagcggaggggcgagagattcggggagacacctttgccgtggctccccaagacttggttatagagcctttaactaaagacagcaaaaacagaagctacaacattataaccggtaccacggatacccagtaccggagctggtttctggcttacaactacggggatcccgataaaggagtgagatcatggaccatactcaccacgacggacgtgacttgcggctcgcaacaagtgtactggtccctgccggatatgatgcaagacccggttaccttccgcccctccacccaagtcagcaacttcccggtggtgggcaccgagctgctgcccgttcacgccaagagcttttacaacgagcaggccgtgtactcccaactcattcgccagtccaccgcgcttacccacgtgtttaatcgcttccccgagaaccagattctcgtgcgccctcccgctcctactattaccaccgtgagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtagtggctcctaaagtgctctctagtcgcaccttctaaacatgtccattctcatctctcccgataacaataccggctggggtctgggatccggcaagatgtacggcggggcgaagcgacgctccagccaacaccccgttcgcgttcggggtcatttccgcgctccttggggtgcttacaagcgaggactctcgggtcgaacggcggtagacgataccatcgatgccgtgatcgccgacgcccgccggtacagccccggagcggtcgccagcaccgcctccaccgtggattccgtgattgacagcgtggtggccggcgcccgggcctatgctcgccgcaaaaagcggctgcaccgcaggcgccgacccacggcggcgatgctggccgcgagggccgtgctgaggcgggcccgcagggtaggcaggagggctatgcgtcgcgccgctgccaacgccgcagccgggagggcccgcaggcaagccgcccgtcaggccgccgccgccattgctagcatggccaggccgaggagagggaacgtgtactgggtgcgcgattctgtgacgggagtccgagtgccggtgcgcagccgacctccccgaagttagaagacgaaagctgcgaagacggcggtactgagtctccctgttgttgtcagcccaacatgagcaagcgcaagtttaaagaagaactcctgcaaaccttggtgcccgagatctatggccctccggacgagaagcctgacattaagccccgcgatatcaagcgcgttaaaaagcgggaaaaaaaagaggagctcgcggtggtagacgatggcggggtagaatttgttaggagtttcgccccgcggcgcagggtgcagtggaaagggcggcgcgttaagcgcgttttaagaccaggcaccgcggtagtttttaccccgggagagcggtcggccgtcaggggttttaagcggcagtacgacgaggtgtacggcgacgaagatattctggaacaggcggctcagcagattggagaattcgcctacggaaagcgctctcgtcaagaagacctggccatcgctttggacgatggcaatcccacgcccagcctcaagcccgtgacgctacagcaggtgctccccgtgagcgccagcgcggacagcaagaggggaattaagcgagagatggacgacctgcaacccaccatacaactcatggttcctaaacgacagaggctagaggaggtcctggagaagatgaaagtggatcctagcatccagcctgaggttaaagtgcggcctattaaagaagtggcccccggactcggggtgcaaacggtggacatccagatcccagttcgatccgcttcgacggccgtggaagccatggaaacgcaaaccgaaactccagttgcggtcggtaccagagaagtggctttgcagacggacccctggtacgaatacgccgctcctcggcgccagaggcgaaccggtcgttacggtccggcaagtgccatcatgccagagtacgcgttgcacccgtccatccagcccacccccggctaccggggggtgacgtatcgtccgtcggcaacccgccgccgctctcgtcgccgccgccgctcccgtcgccctctggcccccgtgtcggtgcggcgcgtaacccgccggggcaaaaccgtcaccatccctaacccgcgctaccaccctagcatcctttaataactctgccgttttgcagatggctctgacttgccgcgtgcgccttcccgttccgcactatcgaggaagatcccgtcgtaggagaggcatggcgggcagtggtcgccgccgggccttgcgcaggcgcatgaaaggcggaattttacccgcgctgattcccataattgccgccgccattggggcgatacctggcgttgcttcagtggccttgcaagcagctcgtaacaaataaacgaaggctttgcacttatgtcctggtcctgactattttatgcagaaagagcatggaagacatcaattttacgtcgctggctccgcggcacggctcgcggccgctcatgggcacctggaacgacatcggcaacagccagctcaacgggggcgctttcaattgggggagcatttggagcggcattaaaaactttggctccacgattaaaaccttcggcaacaaggcctggaacagtagtgctggtcagatgctccgggataaactgaaggacaccaactttcaagaaaaagttgttaatggggtagtaaccggcatacacggcgccgtggatctcgccaaccaagcggtgcagaaagagattgataggcgtttggaaaactccagggtgccgccgcagagaggggatgaaatggaggtggaggaagtagaagttgaggagaaactgcccccgctggaaaaagttcccggtgcgccaccgagaccgcagaaacggcctaggccagaactagaagaaactttagtgacggagagcaaagagcccccctcctacgagcaagctttgaaagagggcgcctctccatatcccatgactaaaccgatcgcacccatggcccgcccggtgtacggaaaggattccagacccgtgacgctagagctcccaccgccgccccctccgcgccccacagtacctccactgccagctccgtcggcgggtcccgtttctgcccctaccgcagcgcctcttccagccgcccgacccgtagccgtggccactgccagaaaccccagaggccagagaggagccaactggcaaagcacgctgaacagcatcgtgggcctgggagtgaaaagcctgaaacgccgccgttgctattattaaaaagtgtagctaaatttcccgttgtatacgcctcctatgttaccgccagagacgcgtgactggtcgccgctaccgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccccaccgtggcccccacccacgatgtaaccacggaccgctcgcagaggctgaccctgcgctttgtgcccgtagaccgggaggacaccgcgtactcttacaaagtgcgctacacgctggccgtaggggacaatcgagtgctggacatggccagtacctactttgacattcgaggggtgctggatcgcggccccagtttcaagccctactccggcaccgcttacaactccctggctcccaagggcgctcccaatcctgcagaatggacaaatactgacagcaaagtcaaagtgagggcgcaagcgccttttgttagctcttacggcgctacagcaattacaaaggagggcgttcaggtgggagtagtcttaacagactcgggatcgacaccacagtatgcggataaaacgtatcagcctgagccgcaaatcggcgagcagcagtggaacagcgatgttggaaccaatgacaaaatagcgggaagggtgttaaagaaaacaactcccatgttcccttgttacggctcatatgccagacccaccaacgaaaaaggagggcaggcgacaccgtccgctagtcaagacgtgcaaaatcccgaattacaatttttcgcctctactaatgtcgccaataccccaaaagcagtactatatgcagaggatgtggcaattgaagccccagacactcacttggtgttcaaaccaacagtaactgaaggaataacaagttcagaagctcttctgacccaacaagctgctcccaaccgaccaaactacatagcctttagagataattttattggtctgatgtactacaatagcactggcaacatgggagtgctagccggacaggcttctcagttgaatgccgttgttgacttgcaagacagaaatactgagctgtcttaccaactcatgttggacgccttgggagaccgcagtcggtacttctctatgtggaaccaagctgtagatagctatgatcctgacgtaagaataatagagaatcacggtgtggaagatgaattgcctaattactgcttccctttgggcggcatggcagtaactgacacctactcacccataaaggtcaatacagcagggaacggatgggaagccaataatgacgtttttaccgacagaggagttgaaataggttcaggcaatatgttcgccatggagattaacctgcaagccaacctgtggcgcagctttttgtattccaacatcgggctctatctcccagactctctgaaaatcacccccgacaacatcacactcccagagaacaagaacacctatcagtacatgaacggccgcgtaacaccacccgggctcgtagatacctacgtgaacgtgggagcgcgctggtcccccgatgtcatggacagcatcaaccccttcaaccaccatcgcaacgccgggctgcgctaccgctccatgctcctcggcaacggccgctatgtacccttccacattcaggtgccgcaaaagttttttgccattaagaacctgctgctgctccccggttcctatacctacgagtggaacttccgcaaggacgttaacatgatcttgcagagctcgctgggcaatgacctgcgtgtggacggggccagcatccgctttgacagtatcaacctctatgccaactttttccccatggcccacaacacggcttccaccctggaagccatgctgcgcaacgacaccaacgaccagtccttcaacgactacctgtgcgcggccaacatgctgtaccccatccccgccaacgccaccagcgtgcccatctctatcccctctcgcaactgggccgccttcaggggttggagtttcactcgcctcaaaaccaaggaaaccccctcgcttggctccggttttgatccctactttgtttactccgggagcattccctacctggatggcactttctacctcaaccacactttcaaaaaggtgtccatcatgtttgattcgtcggtgagttggcccggcaacgaccgcctgctaacgcccaacgaattcgaaatcaagcgttcggtggacggcgaagggtacaacgtggcccagagcaacatgacgaaggactggttcctcattcagatgcttagccattacaatattggctaccagggtttctacgtgcccgagaactacaaggatcgcatgtactccttttttagaaacttccaacccatgagccgccaaattgtagattccacgtcttacactaattaccaggatgtaaaactaccgtatcagcacaacaactcagggttcgtggggtatatggggcccactatgagagaagggcaggcttatccggccaattacccttaccccctaatcggcgccaccgctgtgcccagcttgacgcagaagaagttcctctgcgatagggttatgtggagaatccccttctctagcaactttatgtccatgggggccctcaccgatctggggcagaacatgctgtacgccaactccgcccacgccttggacatgacctttgagctggatcccatggatgagcccacacttctctatgttctgtttgaagtcttcgacgtggtgcgcattcaccagccgcaccgcggcgtcatcgaggccgtctacctgcgcacacctttctctgccggtaacgccaccacctaagaagctgatgggctccagcgaacaggagctacgggccattgttcgcgacctgggctgcgggccctactttttgggcaccttcgacaagcgcttccccggctttatgtccccccacaagccggcctgcgccatcgtgaacacggccgggcgggagaccgggggggttcactggcttgcctttgcctggaacccgcgtaaccgcacttgctacctgttcgacccttttggtttctccgacgaaaggcttaagcagatctaccaattcgaatacgaggggctcctgaagcgtagcgctctggcctccacgcccgaccactgcgttaccctggaaaagtccacccagacggtccaagggcccctttcggcagcctgcggccttttctgctgcatgtttttgcatgcttttgtccactggcccgacacccccatggaccgcaaccccaccatggatctgctcacgggagtgccaaacagcatgcttcacagcccccaggtcacccccaccctgcgccgcaatcaggaacagctgtatggttttttgggaaaacactctgcctatttccgccgccaccggcagcgtatagaacgggccacggcctttgaaagcatgagtcaaagagtgtaatcaataaaatcaacttttattttacacgatacgcgcttttggcgttttcttaaaaatcaaagggctcgagggaggggtcgtcgtgcccgctggggagggatacgttgcgatactggaatcgggagctccaacgaaactcgggaatgaccagccggggcaggaccacctcttccaggttctgcttccaaaactgccgcaccagctgtagggctcccatcacgtcgggcgccgagatcttgaagtcgcagttaggacccgagccaccgcggctgttgcgaaacacgggattggcgcactggaacaccagcacgctggggttgttgatgctggccagagccgtcggatctgtcacctccgaagcatccagatcctcggcgttgctcagggcaaacggggtcagcttgcacatctgccgcccaatctggggcaccaggtcgcgcttattgagacaatcgcaacggagaggaatcaggatgcgacgctgcccgcgttgcataataggatagctcgccgccaggaactcctccatctgacggaaggccatctgggccttagtgccctcggtgtaaaacagcccgcaggacttgctagagaacatgttattgccgcagttgatgtcttccgcgcagcagcgggcgtcttcgttctttagctgaaccacgttgcgcccccagcggttctggaccaccttagctttcgtaggatgctccttcagcgcccgctgcccgttctcgctggtcacatccatttccaccacgtgctccttgcagaccatctccactccgtggaagcagaacagaacgccttcctgctgagtattgcgatgctcccacacggcacacccggtgggctcccagctcttgtgtttcacccccgcgtaagcttccatgtaagccatgaggaatctgcccatcagctcggtgaaggtcttctggttggtgaaggtcagcggcaggccgcggtgctcctcgttcaaccacgtttgacagatcttgcggtacacggctccctgttcaggcagaaacttgaaagcccctctgctctcgttgtccacgtggaacttctccatcaacatcatcatggcttccatacccttctcccacgccgtcaccaggggcgcgctttcggggttcttcaccaacacggtggaagaaccctcgccggccctgatgtcgctcatgcttattttttgaaactcgacagtgccgtccgcgcgacgaactctgcgcaccggagggtagctgaaccccatctccatcacggcgccttcgccctcgctgtcggagacaatctccggggatggcggcggcgcgggggtggacttgcgagccttcttcttgggagggagcggcggcacttcctgttcgcgctcggggctcaactcccgcaagtagggggtgatagagcttccgggttgattctgacggttggccattgtctgatcctaggcagaaagacatggatcttatgggcgaggaaactttaaccgccccgtccccaatcgaagacgtcatcgtcgaacaggacccgggctacgttactccgcccgaggatctggaggggcctttagacgaccggcgcgacgctagtgagcagcaggaaaatgagaaagaggaagcatgctacctcctggaaggcgacattttgctaaagcatttcgccagacagagcaccatagtgaaggaggccttgcaagaccgctcggaggtgcccttggacgtcgccgcgctgtcccaggcctacgaggcgaacctcttctcgccccgggtgcctcccaaaagacagcccaacggcacctgcgagcccaacccgcgcctcaacttctaccccgtgtttgccgtacccgaggcactggccacctatcacatttttttcaagaaccagcgcatccccctctcgtgccgggccaaccgcaccgcggccgatagaaagctgaaacttaaaaacggagccgtcatacctgatatcacgtcgctagaggaagtgcccaagatcttcgagggtctgggtcgagacgagaaacgggcggcgaacgctctgcagagagaacagaaggacagtcagaacgtgctggtggaactggagggggacaatgcgcgtctggccgttctcaagcgctgcatagaagtttcccactttgcctaccctgccctgaacctgccgcccaaagtcatgcgctcggtcatggaccagctgctcatcaagagagctgagcccctgaaccccgagcatcccgaggcggagaactcggaggacggaaagcccgtcgtcagcgacgaggagctccagcggtggctggacaccacggaccccgagcagttgcaagagcggcgcaaaatgatgatggcggccgttctggtcaccgtcgagctggaatgcctgcagcggtttttcagcgacgtggaaacgctgcgcaaactcggagagtccctgcactacacctttcgccagggctacgtccgccaggcctgcaaaatctccaacgtggagctcagcaacctggtttcctacatgggcatcctgcacgaaaaccgcctggggcagagcgtgctgcactgcaccttgcaaggcgaggcgcggcgggactacgtgcgagactgcgtttacctcttcctcactctcacctggcagaccgccatgggagtgtggcagcagtgcttggaagatagaaacctcaaagagctagacaaacttctctgtcgccagcgtcgagccctctggtccggcttcagtgagcgcacggtggcctgcgcgctagcggacatcatcttccctgagcggctgatgaaaaccttacagaacggcttgccggatttcatcagccaaagcattttgcaaaactttcgctcttttgttttggaacgctccgggattttacccgctatgagttgcgcgctgccttctgacttcgtccctctctcctaccgcgagtgccctcccccgctgtggagccactgctaccttttccaactggccaactatctggcctaccactccgacctcatggaagacgtgaacggagaggggctgctggagtgccactgacgctgcaacctctgcaccccccaccgatcgctggcctgcaacaccgagctgctcagcgagacccaggttataggtaccttcgagatccaggggcccgcgcagcaagagggtgcttccggcttaaagctcactccggcgctgtggacctccgcttacttacgcaaatttgtatccgaggactaccacgcccacagaattcaattttacgaggaccaatctcgaccacccaaagcccccctcacggcctgcgtcattacccagagcaaaatcctggcccaattgcagtccattaaccaagcgcgccaagaattccttttgaaaaagggtcggggggtgtatctggacccccagaccggcgaggaactcaacccatccacgctctccgtcgaagcagccgctccgaaacatgccgcccaagggaaccgccaagcagctgatcgctcggcagagagcgaagaagcaggagctgcagcaggtggaagaggaagagctgtgggacagccaggcagaggaagtgtcagaggacgaggaggagatggaaagctgggacagcctagacgaggcggaggaggaggacgagctttcagaggaagaggcgaccgaagaaaaaccacctgcatccagcgcgccttctctgaaccgacagccgaagccccgacccccaacgcccccgcccggctcactcaaagccagccgtaggtgggacgccaccggatcttcagtagcggcggcagcgggtaaggccaaacgcgagcggcgggggtattgttcttggcgggcccacaaaagcagtattgtaaattgcttgcaacactgcgggggaaacatctcctttgcccgtcgctacctcctctttcaccacggtgtggccttccctcgcaacgttctctattattaccgtcatctctacagcccctacgaaacgctcggagaaaaaagctaaggccgccttctctgcgagaaaaaactccgccgccgccgccaccgccgccaaggactcgctagccgcccaggaactgcgaaagcgcatctttcccactctgtacgctatctttcagcaaagccgcgggcagcagccacagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgcttttccccctcggacgcccacgtcatcgccagcatgagcaaggagattcccaccccttacatgtggagctatcagccccagatgggcctggccgcgggggccgcccaagactactccagcaaaatgaactggctcagcgccggcccccacatgatctcacgagttaacggcatccgagcccaccgaaaccaaattctcttagaacaggcggcaatcaccgccacgccccggcgccaactgaacccgcccagttggcccgccgcccaggtgtatcaggaaactcccgccccgaccacagtcctcctgccacgcgacgcggaggccgaagtcctcatgactaactctggggtacaattagcgggcgggtccaggtacgccaggtacagaggtcgggccgctccttactctccggggagtataaagagggtgatcattcgaggccgaggtatccagctcaacgacgaggcggtgagctcctcaaccggtctcagacctgacggagttttccagctcggaggagcgggccgctcttccttcaccactcgccaggcctacctgaccctgcagagctcttcctcgcagcctcgctccgggggaatcggcactctccagttcgtggaggagttcgttccctccgtctacttcaacccgttctccggctcacccggacgctacccggacgccttcattcccaactttgacgcagtgagtgaatccgtggacggctacgactgatgacagatggtgcggccgtgagagctcggctgcgacatctgcatcactgccgccagccccgctgctacgctcgggaggcgtacgtgttcagctactttgagctgccggacgagcaccctcagggtccggctcacgggttgaaactcgaagttgagaaggagctcgagtctcgcctcattgacaccttcaccgcccgccctcttctggtggaaaaggagcacgggaccactaccatcactctgttctgcatctgccccacgcccggattacatgaagatttgtgttgtcatctttgtgctgaatttaataaatagctgttggacttcatctgaggacaactttgtgcccttcaaaggtaccatagacaccatatttttctctgactttaccacctcaattactttaaactgcacctgcactaacgaactaattcagtggcgagccaacagatctttttgtaaagccttcttccgcgacttaacttaccccagtaataactctctctgtacattttgttctcgagaagctttaatactatatcctccctttgttaagggtacttacttgtgcattggttctggcggtgaaaatccttgttttcaccgttggtaccttgacataaaaaactcctctttttctaccacttcaacgccttatacacaacagcgggtaaattacttaccttatataggcttacttgcttttgttttacttttaattgctaattacttactagtctataatttacacacctattactaaaaaatgtttcttttactatttgttaccgctgttgccgctcaaacacttgagaaaccttaccaactttatgctgaagtcggttccaaccttaccataccctactgtagatttactcagtgtccgggagatgtcatatggtatatggaaatgataaattctcctcctattttcaatattaccatttctggtgtgtttactggtcaacggctctgtgagtacacagcaggttctataaaaacatggaactatctttctcttcaatacaattgcaaccacaaaaatttaaatctgttcaatcttcaaattaccgactccgccgtatataatgtaaaaaacgtagagcagtatgtagagtataacacctactacaaactaaatgttatttacattcctgagcctaagtgtgctgttaccacatcttatcttggccgccaagctacaggtgatgaatactgccttattgaaattaactgcaccaattctaagcatcctaacacagttatttttaacaaccgcacagggaattactttgttaaagaacgcggcggtgtaggacctttacctaaccactatgaaacattgtttgacatttatggaattacaaaatcttttacttttacttacccttttgatacgctctgtcaggaaattaattctgttgagtcccttaccgattttacccccatttttatttcaattattgtagttggtgttatagttattatcattagcataggacttttttgctttcaccgccaaaaaaacaagtccaagaccaaacaaaacactaaagttaacattcaactattataatccttgttttccagcatggtagccgctctctgcattcttttctgcttaccaatcatctgcgtttctacaaccttcgcggccgcatcccatctggataccgactgcttgcctccttttttggtttacctaatactgacttttgtggtctgtacttccattaccagtattgcctgcttttttgtaacaatttttcaagccgccgattacgtatacgtacggtttgtctactttagacaccaccctgagtacagaaatcacaacgtagccactctactttgtttagcatgattttggtcttagcgctgtgtactcttatgtaccttggagaatgccactgtccttttaccaaaccttggtccttttacacctgttataatgtattacctgaaacctccatcgcttggctttacgtagccacggcaactttggtctttgtagccacctgcattggagtgaaactgtacttttacttaaaaattggatggcttcatcccccagaagatttacccagatatcctcttgttaataactttcaacagcctcttccgcctcctgatcctctcccgcgagccccctccgttgttagctactttcagctcaccggtggagatgactgactctcaggactttgacattaacttggatcgcatagctgctcagcatcagcgagaaacgcgggttttggaatacattgaactgcaacagctcaaagaatcgcactggtgtgagaaaggagtgctttgccatgttaagcaagcggccctttctttcgatgttagcctgcaaggaagtgagctttcttacaccctgcccccgcaaaaacagactttctgtaccatgctgggttccacttccattacaatcacccagcagaccggtcctaccgaaggggctatcctttgccactgtcacgcgcctgattgtatgtccaaactaatcaaaaccctctgtgctttaggagatatattcaagtaacatgtaatcgcatcaataaacttaccttaaatctgacagcaattttttggtaacattgttcagcagcaccactttaccctcttcccagctctgatatgggatattacggtgggcggcaaatttcctccaaatcctaaacgaaacatggatgtccgcttccttatccttatccacaattttcatcttttcatagatgaaaagaactcgagttgacgaagacttcaatcctgtgtatccatatgatactacatctactccagccgttccttttatatcccctccctttgtaaacagtgatggtttacaggaaaacccacctggcatcttaagcctgcgaatagacagacccctttactttaacacacaaagacaattagcactttccctaggaaacgggttagcaatcaccgccgggggtgaactagaaagcacactgagcgttcgacccaatcccccattggttataaatggtaattcgctttcattgcgctactctgatcccctacgcgtggtgaatgacagcctaacatttaatttcacttcaccactccgttttgaaagcgggagtctcacatttcattacgcgtctccccttaaactaatgaatgacagtctcgctctcgacgtggagccttccaaaggtctcagcacagacggcaataaacttgctgttaagctcagctcagacctaaaatttgacaacaatggagctattgctttcggtatacagagtctatggacagctccaactacaactccaaactgcatgacatacgctgaaaatgactcactacttagtctctgtttaaccaaatgcggcgcccacgtactgggaagcgtaagtctcaccgggtttaccggagatctcttgaacatgaagcaaacaacagtgagtatcgaatttcgattcgataataatggcatattgacaacatctccactagtcaacagcagcagttggggcattagacaaaacaacggtatctacccgaaccctgtctacaatgcgctggcttttatgccaaacagcaccgtttactctcgagggggaggtggcgaaccccgaaacaactactacacccaaacataccttaggggcaatactcaaatacccattaccctcaccgtgacctacaactcagctaatacaggatattccttaacgtttaaatggactgcattaacaaaccaaaaatttgccgctccgactgcttccttttgctatatttcagaacaataaaacccgtttacccaaccgtttcgtttttttcagatgaaacgggtccgaatcgatgaagacttcaacccagtatacccttatgaccccccatacgctcccgttatgcccttcattactccgccttttacctcctcggatgggttgcaggaaaaaccacttggagtgttaagtttaaactacaaggatcccattactacacaaaatggatctctcacgttgaaaataggaaacggcctcactctagacaaccagggacaattaacatcaactgctggggaagtagagcctccgctcactaatgctaacaacaaacttgcactagcctatagcgaaccattagcagtgaaaagcaaccgcataactttatcacacaccgccccccttgtcgttgctgatgattctttagcgttgcaagtttcagaacctatttttatagatgacgatgacaagctagccctgcagacagccgccccccttgtaactaacgctggcacccttcgcttacagagcgccgcccctttaggattggttgaaaatactcttagactgctgttttctaaacccttgtatttgcaaaatgattttcttgcattagccattgaacgccccctggctatagcagccgcaggtactctagcactacaactcactcctccattaaagactaacgatgacgggctaacactatccacagtcgagccattaactgtaaaaaacggaaacctaggcttgcaaatatctcgccctttagttgttcaaaacagcagcctttcgcttgctattacccccccgctgcgtctatttaacagcgaccccgttcttggtttgggctttacttttcccctagctgtaacaaacaacctactctccttaaacatgggagacggtgttaaactaacctacaataaactaacagccaatttgggtagggatttacaatttgaaaacggtgccattgccgtaacgcttactgctgaattacctttgcaatacactaacaaacttcaactgaatattggagctggccttcgttacaatggagccagcagaaaactagatgtaaacattaaccaaaataagggcttaacttgggacaacgatgcagttattcccaaattaggatcaggtttacaattcgaccctaatggtaacatcgctgttatccctgaaaccgtaaagccgcaaacgttatggacaactgcagatccatcgcctaactgctcagtgtaccagaacttggacgccaggctgtggctcgctcttgttaaaagtggtgacatggttcatggaagcattgctctaaaagccctaaaaggaacgttgctaaatcctacagcaagctacatctccattgtgatatatttttacagcaacggagtccggcgtaccaactatcccacgtttgacaacgaaggcaccttagctaacagcgctacctggggataccgagaggggcaatctgctaacactaatgtaaccaatgccactgaatttatgcccagctcaaccaggtaccccgtgaataaaggagacaatattcagaatcaatctttttcatacacctgtatcaaaggagattttgctatgcctgtcccgttccgagtaacatataatcatgccctggaaggatactcccttaagttcacctggcgcgttgtagccaaccaagcttttgatattccttgctgttccttttcatacatcacagaataaaccactttttaaaatttttctttttattttacacgcacagtaaggcttcctccccccttccatctcacagcatacaccagcctctcccccttcatggcagtaaactgttgtgagtcagtccggtatttgggagttaagatccaaacagtctctttggtgatgaaacgtggatccgtgatggacacaaatccctggggcaggttctccaacgtttcggtgaaaaactgcgcgccgccctacaaaacaaacaggttcaggctctccacgggttatctccccgatcaaactcagacaaggtaaaggtgcgatgatattccactaaaccacgcaggtggcgctgtctgaacctctcggtgcgactcctgtgaggctgataggaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcaaacccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctgatagtctgatggaaatccagatctaacgtggcacaacagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagcccgtgcaagtactgaagcaactgtgcgggaatatgcacaacaaaaaaaatagggcggctcagatacatgttgacctaaaataaaaagaattattaaactaaagaagcttgacgaacggtgggataaatgacacgctccagcagcaaacaggcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagcgggaatatccaacgacagctgcaaagacagcaaaacaatccctttgggagcaatcacaaaatcctccggtgaaaaaagcacatacatattagaataaccctgttgctggggcaaaaaggcccgacgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccacgaccaaagttcacccacacccacaaaacccgcgaaaatccagcgccgtcagcacttccgcaatttcagtctcacaacgtcacttccgcgcgccttttcccattcccacacacacccgcccacaaacgccgccctcgcgccaccccgcgtcaccccacgtcaccgcacgtcaccccggccccgcctcgctcctccccgctcattatcatattggcacgcttccagaataaggtatattattgatgatg

SEQ ID NO: 6 - DNA, 35126 bp, Rhesus Adenovirus 4309 (RhAd4309 / RhAd59) Wild Type
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggtccccgagatgtacggtgttttctgcagcgagacggtccggaactcagatgagctgcttaatacagatctgctggatgttcccaactcgcctgtggcttcgcctccgtcgcttcatgatcttttcgatgtggaagtggatccaccgcaagatcccaacgaggacgcggtaaacagtatgttccctgaatgtctgtttgaggcggctgaggagggttctcacagcagtgaagagagcagacggggagaggaactggacttgaaatgctacgaggaatgtctgccttctagcgattctgaaacggaacagacagggggagactgctgtactgagccggtagtgaaaaatgaacttgtattagactgtcctgatcaacctggtcatggctgccgtgcctgtgcttttcatagaaatgccagcggaaatcctgaaactttatgtgctctgtgttacctgcgtcttaccagcgattttgtatacagtaagtaggagctttttcgatttgcgcatggtggtgggattgttaaagtgtgttgggcttattgtttgtgtaatgttttacaggtgacgtgtctgacacggaaggggacggagatagatcagggtctgctaattctccttgcactttgggggctgtggttccagttggcattattaaacccgtggcggtcagagtctcaggcagacggtatgcagttgaaaaattggaagacttgctgcaggaagaacagacggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttattacctatattttggatcaatggagcaacagcgacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttatcggccatggagctctggtgcaggtgcagaccccagaccgggtggctttcaattgcggtatgcagagtttgggccccggggtgataggtttgaatggagttacatttcaaaatgtcaggtttactggtgatgattttaatggctctgtgtttgtgactagcacccagctaaccctccacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgtgccgttcacctaggcgctagacgcggcgtgtttatgccttatcaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacgaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccgaaggggtataaaagggggcgtgcccaccctccccgtcactttcttccgcatcgctgtggaccagagccagctgttcgggtgagtaggccctctcaaaagccggcatgatctcggcgctcaagttgtcagtttctacgaaagaggtggatttgatattcacgtgccccgcagcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcggacggggggtcggcgtcgatggtgaagatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatttcgtcgaagccgttaatgttgtggcccacgatgtaaagttccataaagcgcggctgtcccttgagggccggcgcttttttcaactcctcgtaggtgagacagtccggcgaggagagacccagctcagcccgggcccagtcggagagttgaggattagccgcgaggaaggaactccatagatccaaggccaggagagtttgcaagcggtcgcggaactcgcggaactttttgcccacggccattttctccggtgtcactacgtaaaaagtgtcggaccggtcgttccagacgtcccatcggagctctagggccagctcgcaggcttggtgaacgagggtttcctcgcccgagacgtgcatgaccagcataaagggtaccagttgtttcccgaacgagcccatccatgtgtaggtttctacgtcgtaggtgacaaagagccgctgggcgcgcgcgtgggagccgatcggaaagaagctgatctcctgccaccagctggaggaatgggtgttgatgtggtggaagtagaagccccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtttgcgtctgcgtccttcttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcctgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttaagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggctcgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccatgacggaccagttgacgacttgcatgccgggttgggtgatctccgtgtacttgaggcgcgagtaggcgcgggactcgaacacgtagtcgttgcatgtgcgcaccagatactggtagccgaccagaaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtgaacgccctggtagacagcaaggccatccgccgcgacgaggcggggctgatctacaacgctctgttggaacgggtggcgcgctacaacagcactaacgttcagaccaatctggatcgcctcaccaccgacgtgaaggaggcgctggctcagaaggagcggtttctgagggacagcaatctgggctctctggtggcactgaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgtcaaggccccggtgggcgatcgagccaccatctccagtctgctgacccccaacactcgcctgctgctgctcttgatcgcgccgttcaccaacagtagcactatcagccgtgactcgtacctgggtcatctcatcactctgtaccgcgaggccatcggtcaggctcagatcgacgagcatacgtatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctgaaaaccagcctcccgagtacgaatggtttgagttcaccattcccgagggcaactattccgagaccatgactatcgatctgatgaacaatgcgatcgtggacaattacctgcaagtggggaggcagaacggggtattggaaagcgatatcggtgtgaaatttgacaccagaaacttccgactggggtgggatcccgtgaccaagctggtgatgccaggcgtgtacaccaacgaggcttttcaccccgacatcgtgctgctgccggggtgcggcgtggatttcactcagagccgcttgagtaacctgttagggatcaggaagcgccgtcccttccaggagggctttcagatcatgtatgaggacctggagggaggcaacattccagggctgttagacgttcctgcttatgaggacagcgtgaaaaaggcggaagcccaaggacgggagatacggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctcgggccgaacggcggtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgccgccgccgggagggcccgccgtcaggctgcccgccaggccgccgctgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggttttaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaattaagagagaaatggaagatctgcatcccaccatccaactcatggtccctaaacggcagaggctggaagaggtcctggagaagatgaaagtggaccccagcatagagccggatgtaaaagtcagacctattaaggaagtggcccctggactcggggtgcagacggtggatatccagatccccgtcacgtcagcttcgaccgccgtggaagccatggaaacgcaaacggaaacccctgccgcgatcggtaccagggaagtggcgttgcaaacggagccttggtacgaatacgccgcccctcggcgtcagaggcgacccgctcgttacggccccgccaacgccatcatgccagaatatgcgctgcatccgtctatcctgcccacccccggctaccggggagtgacgtatcgcccgtctggaacccgccgccgaacccgtcgccgccgccgctcccgtcgcgctctggcccccgtgtcggtgcgccgcgtaacacgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggagagcaaggagcctccctcgtacgagcaagctttaaaagagggcgcctctccaccctcctacccgatgactaagccgatcgcacccatggctcgaccggtgtacgggaaggattacaagcccgtcacgctagagctccccccgccgccaccgccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggtgctccaaacccatcagagtggaacggaactgacagcaaaaccaatgtcagaggtcaagcaccattcattagtgatgcaataactaaagagggcataaaagttggtacagacacaggaaaccacggacaagcaatttatgctaaaaaagagtatcagcctgaaccccaagtgggggaaacgcaatggaatagcgacgttggagcaacagacaaagcggcaggacgaattttaaagaaaacgacacccatggttccgtgctatgggtcttatgccaaacccacaaacgaagaagggggtcaggctacaaaccagcaggtagatatgcagttttttgctaccggcagttctaatactacaccaaaggttgtgctgtactctgaagacgtgacgattgagacgcccgacacccacttagtatttaagccaattgtaacagcaggaaccacaaatgcagaagctttgttagcgcagcaagctgctcccaatcgaccaaactacattggctttagagataattttattggtcttatgtactacaacagcactggaaacatgggagtgctggctgggcaggcttcgcagttaaacgctgtggttgatttgcaagacagaaacactgagctatcttatcaactaatgctggatgctttgggggatagaagcagatacttttcaatgtggaatcaagcggtggacagttacgatcccgatgtgagaattgtagaaaaccacggagtagaggacgagttaccaaattactgtttcccgttaggcggtatggcagtaactgatacctacacaggtattaaacctgataatggaggcactacattctcaaatgatgacacttttgcaactagaggaatagaaataggttctggaaacatgttcgccatggagattaatctgcaggctaatctgtggcgtagtttcttgtattccaacatcgggctgtaccttccagacaccttgaaaatcactcccgacaacataacgttgccggacaacaaaaacacctaccagtacatgaatggtcgtgtcactccccccgggcttgtggacacctacgtgaacgtgggtgcgcgctggtcccccgacgtcatggacggcattaaccccttcaaccaccaccgcaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcagctaacatgctgtaccccatccccgccaatgccaccagcgtgcccatctctattccttctcggaactgggctgccttcaggggctggagttttactcgcctcaaaaccaaggagactccctcgctgggctccggttttgacccctactttgtttactccggctccattccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggttcctaattcaaatgctcagtcactataatataggttaccagggcttctatgtgcccgagaactacaaggaccgcatgtactccttcttccgcaacttccaaccaatgagccggcaggtggtagataccgtgacttatacagactacaaggatgtcaagctcccctaccaacacaacaactcagggttcgtgggctacatgggacccaccatgcgagaggggcaggcctacccggccaactatccttatcccctaatcggagagactgctgtacccagcctgacgcagaaaaagttcctctgcgaccgggtgatgtggaggatccccttctctagcaactttatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggagaccgggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttattttaacatgacacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccaaaactgccgcaccagctgcagggctcccatgacgtcgggcgccgatatcttgaagtcgcagttagggccggagctcccgcggctgttccggaacacggggttggcacactggaacaccatcacgctggggttgtggatactggccagggccgtcgggtcggtcacctccgacgcatccagatcctcggcgttgctcagggcaaacggggtcagcttgcacatctgccgcccgatctggggtactaggtcgcgcttgttgaggcagtcgcagcgcagagggatcaggatgcgtcgctgcccgcgttgcatgatagggtaactcgccgccaggaactcctccatttgacggaaggccgtctgggctttggcaccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgtccgttctcgctggttacatccatttctaacacgtgctccttgcagaccatctccactccgtggaagcagaacaggacgccctcctgctgggtactgcgatgctcccatacggcgcatccggtgggctcccagctcttgtgttttacccccgcgtaggcttccatgtaagccatgaggaatctgcccatcagctcggtgaaggtcttctgattggtgaaggtcagcggcaggccgcggtgctcctcgttcaaccaagtttgacagatcttgcggtacacggttccctggtcgggcagaaacttaaaagcccctctgctctcgttgtccacgtggaacttctccatcaacatcgtcatgacttccatgcccttctcccacgccgtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcggggctcatctcccgcaagtagggggtgatggagcttcccgcttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatattgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgatcgtgttcagctactttgagctgccggacgagcaccctcagggtccggctcacgggttgaaactcgagatcgagaacgcgctcgagtctcgcctcatcgacaccttcaccgcccgacctctcctggtagaaatccaacgggggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctccctatagaggtatcatacaaactgtttactttgacaactctactactctcctaaccctcaactgctcttgctctaacgaactaactcagtggattgcaaacggcaccatctgcataacttttcttaattctgaagtttttcaccaacgcaacaactctctgtgcggtaatactactctgcacaccttaaccctcacaccaccttttgcggaacttcaatacttttgcatcggggtaggaaagggaccgagttgctggcaccgttcttttttaaaaaaagctgttccgcctacaattagctctgcttccgctcctaacaattccacttctttaaatttcactctctcagcctatttaacaactcacacttcttggcaacctgttgttactttaacagctcttatcttgttagtgctgtttaactttgttttaattgaatacctagtatcactatgaacaagataattactgcagccttcattattctatgtgtctcctccatcttatgcagcacggaagacgctgaagttgtttatgttaaaataggatctaacaaatctcttgaatcaacctttttacctgatccccccgcaataccgcatattatttggtacaaagaggtttttgattccatttttggcccgcaaaccccctcatattatttttcaggggttaaatattgtgagatttctgaatctaaaaaccaaatctgggatcattatccggcagaatttaattgcataaaccaaagcctcaattttttcaacttaaaaccttcagattctggcctgtaccaagctcaggttattaacaacagtataatatacagtaattacatctatctgtatgttatagatcttccagctccacagtgcgttgtcagttcttattacctcgaagtacaacataagccaagtacatattgcctcatagaaattaactgctcaaaatcagaatatcctgctgaagtcttttttaatggcaaacgaagcaatttacatcactatgtcacagatactgggaacaaacctttgccaaattatttcactaccactattaaagcttatggattaacacaaacttacaaccattcttatgaatttaacgacctttgtaatgatataattgctcttgaaacaggtgctgatttcacgccaattttcatagttaccatagtggtgagcgtgatagtcattattctaggcattacgtacctcatttaccactgtagaactttaaaaacccataaaaaaaccaagcctcctgaaatccgcttactttaatgttttccagaatggtagctgccttcttcattcttctctgtataccaatcatctgcgcctccacaacttttgccgctgtttcccacctggaaccagactgtctaccaccttttgttgtatacctaatactgacttttgtggtctgtacagccattaccagtatagcctgcttttttgtaacaattttccaagccgccgattacctctacgtacggtttgcttactttagacatcaccccgagtatcggaatcaaaacgtagcctctctgctttgtttagcatgattcgcatttttatactttgtaagctctttaccaccacaatatgtcaatgcccttttaccaaaccctggtccttttacacttgttataatgtattacccgaaacccccattgcctggctttacgtagccacagcggctttagtttttgtagcaacctgcattggcgttaaactgtacttttacttaaaaattggatggcttcatcccccagaagatttaccccggtatcctcttgttaataactttcaacagcctctgccgcctcctgatcttcttcctcgagctccctctgttgtgagctactttcaactcaccggtggagatgactgactctcaggacattaatattagtgtggaaagaatagctgctcagcgtcagcgagaaactcgagtgatggagtaccttcaactacagcagcttaaggagtcccactggtgtgagaaaggagtgctgtgccatgttaagcaggcggccctttcttacgatgtcagcctccagggacatgaactgtcttacactttgccttcgcaaaaacaaaccttctgcaccatgatgggtcctacctctatcacaatcacccaacaaaccggacctgtcgagggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctgagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcatgtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttaacagcgagccccaactgggcgtacactttaatccccctatcaccgtgcaacaaggcggtctggccttaaatacgggggatggtttgcaagtatatcttaacaaactaacgctaaacataggcagagacttgcaatatgaaaacgggtcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgagtcagtccggtatttgggagttaagatccaaacagtctctttggtaatcagatgtcgatccgtgatggacacaaatccctggggcaggttctccaacgtttcggtgaaaaactgcgtgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagctctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtataaagccacgaaaaagtcgagctaaaatccacccaacagcctatagctatatatacactccgcccaatgacgctaacaccgcaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccacgtcaccgcacgtcaccgcacgtcaccccggccccgcctcgctcctccccgctcattatcatattggcacgtttccagaataaggtatattattgatgatg

SEQ ID NO: 7 - DNA, 35182 bp, Rhesus Adenovirus 4310B (RhAd4310B / RhAd60) Wild Type
catcatcaataatataccttattctggaaacgtgccaatatgataatgagcggggaggagcgaggcggggccggggtgacgtgcggtgacgcggggtgacgcggggtggcgcgagggcggggcgggtgtggggaggcgcttagttttcacgtatgcggaaggaggttttataccggaagttgggtaatttgggcgtatacttgtaagttttgtgtaatttggcgcgaaaaccgggtaatgaggaagttgaggttaatatgtacgttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggttcccgagatgtacggtgttttctgcagcgagacggcccggaactcagatgagctgcttaatacagatctgctggatgttcccaactcgcctgtgacttcgcttccgtcgcttcatgatcttttcgatgtggaagtggatccaccgcaagatcccaacgaggacgcggtaaacagtatgttccctgaatgtctgtttgaggcggctgaggagggttctcacagcagtgaagagagcaaacggggagaggaactggacttgaaatgctacgaggaatgtctgccttctagtgattctgaaacggaacaaacagggggagactgctgtactgagccggtagtgaaaaatgaacttgtattagactgtcctgatcaacctggtcatggctgccgtgcctgtgcttttcatagaaatgccagcggaaatcctgaaactctatgtgctctgtgttacctgcgtcttaccagcaattttgtatatagtaagtaggagctttttcgatttgcgcatggtggtgggattgttaaagtgtgttgggcttattgtttgtgtaatgttttacaggtgacgtgtctgacgcggaaggggacggagatagatcagggtctgctaattctccttgcactttgggggctgtggttccagttgacattattagacccgtggcggtcagagtatcaggcagacggtgtgcagttgaaaaattggaagacttgctgcaggaagaacagacggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcttatattttggatcaatggagcaacagcgacagccacctgtcgtgggagtacatgctggattacatggcgatggctctgtggagggccatgctgcggaggagggtttgcatttacttgcgggcgcagcctccgcggctggatcgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttatcggccatggagctctggtgcaggtgcagaccccagaccgggtggctttcaattgcggcatgcagagtttgggccccggggtgataggtttgaatggagttacatttcaaaatgtcaggtttactggtgatgattttaatggctctgtgtttgtgactagcacccagctaaccctccacggggtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgtgccgttcacctaggtgctagacgcggcgtgtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagccacgaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaaatttgttgaaaataaacggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtgaaagaatttagagacccccttgtgtccccctaggttttccatgcactcatccataatgatggcaatgggacccctggcggccgctttggcaaacacgttttgggggttggaaacatcatagttttgctctagcgtgagctcatcataggccatcttaacaaagcggggtaggagggtgcccgactgggggatgatagttccatctgggcctggagcgtagttgccctcacagatctgcatctcccaggccttaatttccgaggggggtatcatgtccacctggggggcgataaagaacacggtttctggcggggggttgatgagctgggtggaaagcaagttacgcaacagctgggatttgccgcaaccggtgggaccgtagatgaccccgatgacgggttgcagctggtagttgagagaggagcagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctctgtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagtcccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaaaaccgactcgggcgagtaggcgtcggccccgcactgagcgcagacggtttcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtgtccccgtacaccgacttgagggggcgatattccaaaggcgttccgaggtcttccgcgtacaggaactgggaccactccgagacgaaggctctggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgatccgcaccccccaaaggggtataaaagggggcgtgcccaccctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaagggtccatctgatcagaaaacacgatctttttattgtcaagtttggtggcgaaagacccgtagagggcgttggaaagcaacttggcgatggagcgcagggtctgatttttctcccgatcggccctctccttggcagcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccgggcagtcccacggagtcttggatgaactgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccacacatcccattggagctctagggccagctcgcaggcttggtgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttaagacgggggcttggtggggcggcatccctttcgccttggcggtgggagtctgcgtctgcgccctccttctctgggtggacgacggtggggacgacgacgccccgtgtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcaatcgtcgagggcgagcgccggggggtagaggcggctctgcgccggggggcagcggaggcagcggcacgttttcgtgaggatttggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaagaaagcgtctatccaatcgcagtcgcaaggtaagctgaggacagtgggtcgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggcgcgggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcccggacgcggttccagatgttgcgcaggggacggaagcgttccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcttacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgtgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacgcacgagaaagtcctgactatcgtgaatgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgtgactcgtacctgggtcatctcatcactttgtaccgcgaggccatcggtcaggctcagattgacgagcatacatatcaggagatcactaacgtgagccgggccctgggtcaggaagataccggcagcctggaagccacgttgaactttttgctaaccaaccggaggcaaaaaataccctcccagtttacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggcgagtttgacctgcccgaagccgacgacggctttctttgggacgacgtgtccgacagcattttcacgccgggcaatcgccgattccagaagaaggagggcggagacgagctccccctctccagcgtggaggcggcctctaggggagagagtccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaactcggcagccccgatacgagtggttcgagtttaccattccagagggcaactattccgaaactatgactatcgatctcatgaataacgcgatcgtggacaattacctgcaagtggggagacagaacggggtgctggaaagcgatatcggcgtgaaattcgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttaggaattagaaagcgccgcccattccaagagggctttcaaatcatgtatgaggacctggagggaggtaatatacccgccttactggacgtgtcgaagtacgaagctagcatacaacgcgccaaagcggagggtagagagattcggggagacacctttgcggtagctccccaggacctggaaatagtgcctttaactaaagacagcaaagacagaagctacaatattataaacaacacgacggacaccctgtatcggagctggtttctggcttacaactacggagaccccgagaaaggagtgagatcatggaccatactcaccaccacggacgtgacctgtggctcgcagcaagtgtactggtccctgccggatatgatgcaagacccggtcaccttccgcccctccacccaagtcagcaacttcccggtggtgggcaccgagctgctgcccgtccatgccaagagcttctacaacgagcaggccgtctactcgcaacttattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtggtggctcctaaagttctttctagtcgcaccttctaaaaacatgtccatcctcatctctcccgataacaacaccggctggggactgggctccggcaagatgtacggcggagccaaaaggcgctccagtcagcacccagttcgagttcggggccacttccgcgctccttggggagcttacaagcgaggactctcgggtcgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggcaggcagaagggctatgcgccgcgctgccgccaacgccgccgccgggagggcccgccgacaggctgcccgccaggctgctgctgccatcgctagcatggccagacccaggagagggaacgtgtactgggtgcgtgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagagggggattaagagagaaatggaagatctgcatcccaccatccaactcatggtccctaaacggcagaggctggaagaggtcctggagaagatgaaagtggaccccagcatagagccggatgtaaaagtcagacctattaaggaagtggcccccggtcttggggtgcaaacggtggacattcaaatccccgtcaccaccgcttcaaccgccgtggaagctatggaaacgcaaacggagacccctgccgcgatcggtaccagggaagtggcgttgcaaacggagccttggtacgaatacgcagcccctcggcgtcagaggcgttccgctcgttacggccccgccaacgccatcatgccagaatatgcgctgcatccgtctattctgcccactcccggataccggggtgtgacgtatcgcccgtctggaacccgccgccgaacccgtcgccgccgccgctcccgtcgcgctctggtccccgtgtcggtgcggcgtgtgacccgccggggaaagacagtcgtcattcccaacccgcgttaccaccctagcatcctttaataactctgccgttttgcagatggctctgacttgccgcgtgcgccttcccgttccgcactatcgaggaagatctcgtcgtaggagaggcatgacgggcagtggtcgccggcgggctttgcgcaggcgcatgaaaggcggaattttacccgccctgatacccataattgccgccgccatcggtgccatacccggcgttgcttcagtggcgttgcaagcagctcgtaataaataaacaaaggcttttgcacttatgacctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaatggggtggtgaccggcatccacggcgcggtagatctcgccaaccaagcggtgcagaaagagattgacaggcgtttggaaagctcgcgggtgccgccgcagagaggggatgaggtggaggtcgaggaagtagaagtagaggaaaagctgcccccgctggagaaagttcccggtgcgcctccgagaccgcagaagcggcccaggccagaactagaagagactctggtgacggagagcaaggagcctccctcgtacgagcaagccttgaaagagggcgcctctccaccctcctacccgatgactaagccgatcgcacccatggctcgaccggtgtacggcaaggattacaagcccgtcacgctagagctgcccccaccgccccccacgcgcccgaccgtcccccccctgccgactccgtcggcggccgcggcgggacccgtgtccgcaccatccgctgtgcctctgccagccgcccgtccagtggccgtggccactgtcagaaaccccagaggccagagaggagccaactggcaaagcacgctgaacagcatcgtgggcctgggagtgaaaagcctgaaacgccgccgttgctattattaaaaaagtgtagctaaaaagtctcccgttgtatacgcctcctatgttaccgccagagacgagtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggagctcccaacccctcggaatggacggacacttccgacaacaaacttaaagcatatgctcaggctccctaccagagtcaaggacttacaaaggatggtattcaggttgggctagttgtgacagagtcaggacaaacaccccaatatgcaaacaaagtgtaccaacccgagccacaaattggggaaaaccaatggaatttagaacaagaagataaagcggcgggaagagtcctaaagaaagatacccctatgtttccctgctatgggtcatatgccaggcccacaaacgaacaaggagggcaggcaaaaaaccaagaagtagatttacagttttttgccactccgggcgacacccagaacacggctaaagtggtactttatgctgaaaatgtcaacctggaaactccagatactcacttagtgtttaaacccgatgacgacagcaccagttcaaaacttcttcttgggcagcaggctgcacctaacagacccaactacataggttttagagataattttattggtttaatgtactacaatagcactggaaacatgggcgtgctggccggacaggcttctcaattgaatgccgtagtcgacttgcaggacagaaacaccgagttgtcctaccagctgatgctggacgcactgggggatcgcagccgatatttttcaatgtggaatcaggcagtagacagctatgacccagacgttagaattatagaaaaccacggagtggaagacgaactgccaaactattgttttcctctgggaggaatggtggtgactgacaattacaactctgtgacgcctcaaaatggaggcagtggaaatacatggcaggcagacaatactacatttagtcaaagaggagcgcagattggctccggaaacatgtttgccctggaaattaacctacaggccaacctctggcgcggcttcttgtattccaatattgggttgtatcttccagactctctgaaaatcacccccgacaacatcacgctgccagaaaacaaaaacacttatcagtacatgaacggtcgcgtaacgccacccgggctcatagacacctatgtaaacgtgggcgcgcgctggtcccccgatgtcatggacagcattaaccccttcaaccaccaccgtaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcggctaacatgctgtaccccatccccgccaacgccaccagcgtgcccatctctattccttctcggaactgggctgccttcaggggctggagttttactcgcctcaaaaccaaggagactccctcgctgggctccggttttgacccctactttgtttactccggctccattccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggtttctaattcaaatgctcagtcactataatataggttaccagggcttctatgtgcccgagaactacaaggaccgcatgtactccttcttccgcaacttccaaccaatgagccggcaggtggtagataccgtgacttatacagactacaaagatgtcaagctcccctaccaacacaacaactcagggttcgtgggctacatgggacccaccatgcgagagggacaggcctacccggccaactatccctaccccctgatcggagagactgccgtacccagcctcacgcagaaaaagttcctctgcgaccgggtgatgtggaggatacccttctctagcaactttatgtcgatgggctccctcaccgacctggggcagaacatgctgtacgccaactccgctcacgccttggacatgacttttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggttccagcgaacaggagttgcaggccattgttcgcgacctgggctgcgggccctgctttttgggcaccttcgacaagcgttttcccggattcatgtccccccacaagccggcctgcgccatcgttaacacggccggacgggagaccgggggggtgcactggctcgccttcgcctggaacccgcgcaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacacccccatggagcgcaaccccaccatggatctgctcaccggagtgcccaacagcatgcttcacagtccccaggtcgcccccaccctgcgccgcaatcaggaccacctgtatcgctttctggggaaacactctgcctatttccgccgccaccggcagcgcatcgaacaggccacggccttcgaaagcatgagccaaagagtgtaatcaataaaaaccgtttttatttgacatgatacgcgcttctggcgtttttattaaaaatcgaagggttcgagggaggggtcctcgtgcccgctggggagggacacgttgcggtactggaatcgggcgctccaacgaaactcggggattaccagccgcggcagggccacgtcttccatgttctgcttccaaaactgtcgcaccagctgcagggctcccatcacgtcgggcgctgagatcttgaagtcgcagttagggccggagcccccgcggctgttgcggaacacggggttggcacactggaacaccaacacgctggggttgtggatactagccagggccgtcgggtcggtcacctccgatgcatccagatcctcggcattgctcagggcgaacggggtcagcttgcacatctgccgcccgatctggggtaccaggtcgcgcttgttgaggcagtcgcagcgcagagggatgaggatgcgacgctgcccgcgttgcatgatggggtaactcgccgccaggaactcctctatctgacggaaggccatctgggccttgacgccctcggtgaaaaatagcccacaggacttgctggaaaacacgttattgccacagttgatgtcttccgcgcagcagcgcgcatcttcgttcttcagctgaaccacgttgcgaccccagcggttctgaaccaccttggcttttgtgggatgctccttcagcgcccgctgtccgttctcgctggtcacatccatttccaccacgtgctccttgcagaccatctccactccgtggaaacagaacagaatgcccgcctgttgggtattgcgatgctcccacacggcgcacccggtggactcccagctcttgtgtttcacccccgcgtaggcttccatgtaagccattagaaatctgcccatcagctcagtgaaggtcttctggttggtgaaggttagcggcaggccgcggtgttcctcgttcaaccaagtttgacagattttgcggtacacggctccctggtcgggcagaaacttaaaagtcgttctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggacattttttgaaactccacggtgccgtccgcgcggcgtactctgcgcatcggagggtagctgaagcccacctccatgacggtgccttcgccctcgctgtcggagacgatctccggggagggcggcggaacgggggcagacttgcgagccttcttcttgggagggagcggaggcacctcctgctcgcgctcgggactcatctcccgcaagtagggggtgatggagcttcctggttggttctgacggttggccattgtatcctaggcagaaagacatggagcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcggccgataggaagctaacactcagaaacggagtcagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctgaccgtcctcaaacgttgcatagaagtttcccacttcgcctacccggccctcaacctgccgcccaaagttatgaaatcggtcatggaccagctactcatcaagagagctgagcccctgaatcccgaccaccctgaggcggaaaactcagaggacggaaagcccgtcgtcagcgacgaggagctcgagcggtggctggaaaccagggacccccagcagttgcaagagaggcgcaagatgatgatggcggccgtgctggtcacggtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggtgtgtggcagcagtgcttggaagagagaaacctcaaagagctggacaaactcctctaccgccagcggcgggccctctggaccggcttcagcgagcgcacggtcgcctgcgccctggcagacatcattttcccagaacgcctgatgaaaaccttgcagaacggcctgccggatttcatcagtcagagcatcttgcaaaacttccgctccttcgtcctggagcgctccgggatcttgcccgccatgagctgcgcgctgccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaaaatcctggcccaattgcaatccatcaaccaagcgcgtcgagatttccttttgaaaaagggtcggggggtgtacctggacccccagaccggcgaggaactcaacccgtccacactttccgtcgaagcagcccccccgagacatgccacccaagggaaccgccaagcagctgatcgctcggcagagagcgaagaagcaagagctgctccagcagcaggtggaggacgaggaagagctgtgggacagccaggcagaggaggtgtcagaggacgaggaggagatggaaagctgggacagcctagacgaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcatcgtcagcatgagcaaggagattcccaccccctacatgtggagctatcagccgcagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggctgaagtcctcatgactaactctggggtacaattagcgggcgggtccaggtacgccaggtacagaggtcggaccgctccttactctcccgggagtataaagagggtgatcattcgaggccgaggtatccagctcaacgacgaggcagtgagctcctcaaccggcctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaacgaactaattcagtggtttgctaacagttcactctgtaaagtatttcttaattctaaggtttttcctggattcggcagttcctcgtgtggaaacgttacccattcctccttaactgtctcagcgcctttttcagaaatccaatatttctgtattggagcaggaggtgaagcgggttgcgttcaccgttcgtttcttaaacgatttgttgctgttcctgttaacacctccctttcatctcattcttacttcatttacccccctgctcaccactcttggcaaccccttattggcctaacagctttcattaccatagttttacttaactttataatcattaacagactttcttaaaaaatgctgataattttgcttattactttcactcttgctgctgcttcccccaaatcaaatgatggttttatagacgtatatgctaaacaagggacaaacttacttatgcaatctcactatgcacctccagacgttattacacatattgcttggtacttagatgtttttcagggcattttcgacacaactataccttcatattttacgggggttaagctttgtgaaagctcaccacttcaagaacaggaatggtttcacccacctctacaatttcattgcataaacaatagcctacacttgtacaatctgaaacctagcgatgctggtgtttataatgctaaagttttttcagattccattgaacataatacatactttcaactacatgtgatttcttttccaaaacctaactgtaacattaactctacttacctaacaaacgactactgccttattaacatcgactgttccaaattatcatacccggccaaagtttattttaatggtaatcaaagtaaacttcattactatttatctgcacgcggaggcaacggaaaccttccagattattttactgttggctatgaatacagagacctcaaacaaaattatacagttcactatccattcaatgacctttgtgcagaaataaccgctcttgaaacggggtctgatttcacccctatctttatagttaccatagcggttagtgttatagttataattttagccattacatacttcatctaccactgtagaactttaaaaaaaaccaagaaaaacaagcctcctgaaatccgtttgctttaattttttccagaatggtagctgctttcttcattcttctctgtataccaatcatctgcgcctccacaacttttgctgctgtttcccacctggaaccagactgtctacaaccttttgttgtatacctaatactgacttttgtggtctgcacggccattaccagtatagcctgcttttttgtaacaattttccaagccgccgattacctctacgtacggtttgcttattttagacatcaccccgagtatcggaatcaaaacgtagcttctctgctttgtttagcatgattcgcatttttatactttgtaagctctttaccctcacaacatgtcattgtccttttaccaaaccctggtccttttacacttgttataatgtattgcccgaaacccctattgcctggctttacgtagccacagcggttttagtttttgcagcaacctgcattggagttaaactgtacttctacttaaagattggatggcttcatcccccagaagatttaccccgatatcctcttgttaataactttcaacagcctctgccgcctcctgatcctcttccgcgagctccctccgttgttagctactttcaactcaccggtggagatgactgactctcaagacattgatattaatgtggaaagaatagctgctcagcgtcagcgagaaacgcgggtgctggactaccttgaactacagcagcttaaagagtcccactggtgtgagaaaggagtgctgtgccatgttaagcaggcagccctttcttacgatgtcagcctccagggacatgaactatcttacactttgccttcgcaaaaacaaaccttctgcaccatgatgggccctacctccatcacaatcacccaacaaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatccagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgttgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggcgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcagagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccaccaccaaagttcgcccacacccacaaaacccgcgaaaatccagcgccgtcagcacttccgcaatttcagtctcacaacgtcacttccgcgcgccttttccctttcccacacacgcccttcgcccgccccgccctcgcgccaccccgcgtcaccccgcgtcaccgcacgtcaccccggccccgcctcgctcctccccgctcattatcatattggcacgtttccagaataaggtatattattgatgatg

SEQ ID NO: 8 - DNA, 35192 bp, Rhesus Adenovirus 6665 (RhAd6665 / RhAd61) Wild Type
  misc_feature (105)..(110): n is a, c, g, or t
catcatcaataatataccttattctggaaacgtgccaatatgataatgagcggggaggagcgaggcggggccggggtgacgtgggaatggggagaggggcggggnnnnnnggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggtccccgagatgtacggtgttttctgcagcgagacggtccggaactcagatgagctgcttaatacagatctgctggatgttcccaactcgcctgtggcttcgcctccgtcgcttcatgatcttttcgatgtggaagtggatccaccgcaagatcccaacgaggacgcggtaaacagtatgttccctgaatgtctgtttgaggcggctgaggagggttctcacagcagtgaagagagcagacggggagaggaactggacttgaaatgctacgaggaatgtctgccttctagcgattctgaaacggaacagacagggggagactgctgtactgagccggtagtgaaaaatgaacttgtattagactgtcctgatcaacctggtcatggctgccgtgcctgtgcttttcatagaaatgccagcggaaatcctgaaactttatgtgctctgtgttacctgcgtcttaccagcgattttgtatacagtaagtaggagctttttcgatttgcgcatggtggtgggattgttaaagtgtgttgggcttattgtttgtgtaatgttttacaggtgacgtgtctgacacggaaggggacggagatagatcagggtctgctaattctccttgcactttgggggctgtggttccagttggcattattaaacccgtggcggtcagagtctcaggcagacggtatgcagttgaaaaattggaagacttgctgcaggaagaacagacggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcctatattttggatcaatggagcaacagcaacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttatcggccatggagctctggtgcaggtgcagaccccagaccgggtggctttcaattgcggtatgcagagtttgggccccggggtgataggtttgaatggagttacatttcaaaatgtcaggtttactggtgatgattttaatggctctgtgtttgtgactagcacccagctaaccctccacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgtgccgttcacctaggcgctagacgcggcgtgtttatgccttatcaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggtcgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggtggatttgatatttacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgtctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccataacggaccagttgacgacttgcatgccgggttgggtaatctccgtgtacttgaggcgcgagtaggcgcgggactcgaacacgtagtcgttgcatgtgcgtaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggctgcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgcctcaccacggacgtgaaggaggcgctggctcagaaggagcgctttctgagggacagcaatctgggttctctggtggcactcaacgccttcctgagcacgcagccggccaacgtgccccgcgggcaggaggactacgtgagcttcattagcgctctgaggctgctggtgtccgaggtgccccagagcgaggtgtatcagtccggaccggattacttttttcagacgtcccgccagggcttgcaaacggtgaacctgactcaggcctttaaaaacttgcaaggtatgtggggcgtcaaggccccggtgggcgatcgcgccaccatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagtcgggctctgggtcaggaagacaccggcagcttggaagccacgttgaactttttgctgaccaaccggaggcaaaaaataccctcccagttcacgttaagcgccgaggaagagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaacccaacagccccgatacgagtggtttgagtttactattccagagggcaactactccgagaccatgactatcgatctaatgaataacgcgatcgtggacaattacctgcaagtggggaggcagaacggggtattggaaagcgatatcggtgtgaaatttgataccagaaacttccgactggggtgggatcccgtgaccaagctggtgatgccaggcgtgtacaccaacgaggcttttcaccccgacatcgtgctgcttccggggtgtggtgtggactttactcagagccgcttgagtaacctgttaggaatcaggaagcgccgtcccttccaggagggctttcaaatcatgtatgaggacctggagggaggtaacattccaggcttgctagacgtgccggcgtatgaacaaagcttacagcaagcccaagaggaggggcgagtaactcgcggagacacctttgctacggctccccatgagttggtgattcagcctttaacgaaagacagtaaaaacagaagttacaaccttatacccaactctacggatacactgtaccggagctggttcctggcttacaactacggcgatcccgagaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtccaccgcgcttacccacgtgttcaatcgctttcccgagaaccagattttggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctcgggccgaacggcggtagacgataccatagatgccgtgattgccgacgcccgccggtacaatcccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgcctccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcggcgcagggttcaatggaaagggcgacgggtacaacgcgttttgaggccgggcaccgcggtagtttttaccccgggagagcggtcggccgttaggggttttaaaaggcagtacgacgaggtgtacggcgacgaggacatattggaacaggcggctcgacagatcggagaatttgcctacggaaagcgttcgcgtcgcgaagaactggccatcgccttagacagcggcaaccccacacccagcctcaaacccgtgacgctgcagcaggtgcttcccgtgagcgccagcacggacagcaagaggggaataaaaagagaaatggaagatctgcagcctaccatccagctcatggttcctaaacggcagaggctggaagaggtcctggagaagatgaaagtggacccaagcatagagccggacgttaaagtcaggccgatcaaagaagtggcccctggactcggggtgcagacggtggatatccagatccccgtcacgtcagcttcgaccgccgtggaagccatggaaacgcaaaccgaaacccccgccgcggttggtaccaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcggcgcgtggcccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaaatggaggtcgaggaagtagaagtagaggaaaagctgcccccgctggagaaagttcccggtgcgcctccgaggccgcagaagcggcccaggccagaactagaagaaactctggtgacggagagcaaggagcctccctcgtacgagcaagccttgaaagagggcgcctctccaccctcctacccgatgactaagccgatcgcacccatggctcgaccggtgtacggcaaggattacaagcccgtcacgctagagctccccccgccgccaccgccgccccccacgcgcccgaccgttccccccctgccggctccgtcggcgggtcccgtgtctgcaccatccgctgtgcctctgccagccgcccgtcccgtggccgtggccactgccaggaaccccagaggccagagaggagccaactggcaaaacacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagcgccgcttccaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctacttcgacatccggggggtgctggataggggtcctagcttcaagccctactccggcaccgcttacaactccctggcccccaagggcgcccctaaccctgcagaatgggaagatactaatgacagcaacaaactcaaagtgaggggacaggcgccttatgttagcacgttcggcgccgctacggcgcttacaaaagatggcattcaggtgggagtgaccgtatcagagtccgcacgaactccgcagtacgcggacaaaagttaccaaccagaacctcaaattggggagacagagtggaacagcgaagtaggtaacgatgacaaattagcaggcagggtgctaaaaaaatcaacgccaatgttcccttgttacggatcatatgccaaacccaccaacgaaaaaggcggacaagcaatacagcctgccggcagcagcggagacactaatccggcagtagagttgcagttcttcgccactactagcgctactactactccaaaagcagtgttatatgcagaggacgtagccatagaagcaccagatactcatttggtgtttaagccgacagtaactgcaggaactacaagttcggaagctctgttaacccaacaagctgcacctaaccgtccaaactacattgcattcagagataacttcattggacttatgtactacaacagtacaggaaatatgggagtgctggccgggcaggcatctcagctaaatgcagtggttgatttgcaagacagaaacactgaactgtcttaccagctaatgttggatgctctcggagaccgcagtcggtacttctctatgtggaatcaagcagtggacagttacgatccagatgttagaattgtggaaaatcacggagtggaggatgagttaccaaattattgctttcctttgggagggatggtagtaactgacacctacacgcccataaaacccaatggcagtggaagtgtcacgtggacagccaatactgacgttttcagcaatagagtggaaataggctccgggaacctgttcgccatggaaatcaacctgcaagccaatctgtggcggagctttctgtattccaacatcgggctgtatctccccgactccctaaaaatcacccccgacaatattacgctgccagagaacaaaaacacttaccagtacatgaacggtcgcgtgacacctcccgggctcatagacacctacgtcaacgtgggtgcgcgctggtcccccgatgttatggacagcatcaacccctttaaccaccaccgcaacgcggggctgcgttaccgctctatgctgctgggcaacggccgctacgtgcccttccacattcaggtgccccagaaattctttgccattaagaacctgctgctgctccccggttcctacacctacgagtggaacttccgcaaggacgtgaacatgatcttgcagagctcgctgggcaatgacctgcgagtggacggagccagcatccgcttcgacagcatcaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcctccgtcagctggcccggcaacgaccgtctgcttacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtaatgtggaggatacccttctctagcaacttcatgtctatgggatccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggagaccgggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttattttaacatgacacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccaaaactgccgcaccagctgcagggctcccatgacgtcgggcgccgatatcttgaagtcgcagttagggccggagctcccgcggctgttccggaacacggggttggcacactggaacaccatcacgctggggttgtggatactggccagggccgtcgggtcggtcacctccgacgcatccagatcctcggcgttgctcagggcaaacggggtcagcttgcacatctgccgcccgatctggggtactaggtcgcgcttgttgaggcagtcgcagcgcagagggatcaggatgcgtcgctgcccgcgttgcatgatagggtaactcgccgccaggaactcctccatttgacggaaggccatctgggctttggcaccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgtccgttctcgctggttacatccatttctaacacatgctccttgcagaccatctccactccgtggaagcagaacaggacgccctcctgctgggtactgcgatgctcccatacggcgcatccggtgggctcccagctcttgtgttttacccccgcgtaggcttccatgtaagccatgaggaatctgcccatcagctcggtgaaggtcttctgattggtgaaggtcagcggcaggccgcggtgctcctcgttcaaccaagtttgacagatcttgcggtacacggttccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcggggctcatctcccgcaagtagggggtgatggagcttcccgcttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgatcgtgttcagctactttgagctgccggacgagcaccctcagggtccggctcacgggttgaaactcgagatcgagaacgcgctcgagtctcgcctcatcgacaccttcaccgcccgacctctcctggtagaaatccaacgggggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctccctatagaggtatcatacaaactgtttactttgacaactctactactctcctaaccctcaactgctcttgctctaacgaactaactcagtggattgcaaacggcaccatctgcataacttttcttaattctgaagtttttcaccaacgcaacaactctctgtgcggtaatactactctgcacaccttaaccctcacaccaccttttgcggaacttcaatacttttgcatcggggtaggaaagggaccgagttgctggcaccgttcttttttaaaaaaagctgttccgcctacaattagctctgcttccgctcctaacaattccacttctttaaatttcactctctcagcctatttaacaactcacacttcttggcaacctgttgttactttaacagctcttatcttgttagtgctgtttaactttgttttaattgaatacctagtatcactatgaacaagataattactgcagccttcattattctatgtgtctcctccatcttatgcagcacggaagacgctgaagttgtttatgttaaaataggatctaacaaatctcttgaatcaacctttttacctgatccccccgcaataccgcatattatttggtacaaagaggtttttgattccatttttggcccgcaaaccccctcatattatttttcaggggttaaatattgtgagatttctgaatctaaaaaccaaatctgggatcattatccggcagaatttaattgcataaaccaaagcctcaattttttcaacttaaaaccttcagattctggcctgtaccaagctcaggttattaacaacagtataatatacagtaattacatctatctgtatgttatagatcttccagctccacagtgcgttgtcagttcttattacctcgaagtacaacataagccaagtacatattgcctcatagaaattaactgctcaaaatcagaatatcctgctgaagtcttttttaatggcaaacgaagcaatttacatcactatgtcacagatactgggaacaaacctttgccaaattatttcactaccactattaaagcttatggattaacacaaacttacaaccattcttatgaatttaacgacctttgtaatgatataattgctcttgaaacaggtgctgatttcacgccaattttcatagttaccatagtggtgagcgtgatagtcattattctaggcattacgtacctcatttaccactgtagaactttaaaaacccataaaaaaaccaagcctcctgaaatccgcttactttaatgttttccagaatggtagctgccttcttcattcttctctgtataccaatcatctgcgcctccacaacttttgccgctgtttcccacctggaaccagactgtctaccaccttttgttgtatacctaatactgacttttgtggtctgtacagccattaccagtatagcctgcttttttgtaacaattttccaagccgccgattacctctacgtacggtttgcttactttagacatcaccccgagtatcggaatcaaaacgtagcctctctgctttgtttagcatgattcgcatttttatactttgtaagctctttaccaccacaatatgtcaatgcccttttaccaaaccctggtccttttacacttgttataatgtattacccgaaacccccattgcctggctttacgtagccacagcggctttagtttttgtagcaacctgcattggcgttaaactgtacttttacttaaaaattggatggcttcatcccccagaagatttaccccggtatcctcttgttaataactttcaacagcctctgccgcctcctgatcttcttcctcgagctccctctgttgtgagctactttcaactcaccggtggagatgactgactctcaggacattaatattagtgtggaaagaatagccgctcagcgtcagcgagaaacgcgagtgttggaatacctggagctacagcaacttaaagagtcccactggtgtgagaaaggagtgctgtgccatgttaagcaggcagccctttcctacgatgtcagcgttcagggacatgaactatcttacactttgccttcgcagaaacaaaccttctgcaccatgatgggctctacctccatcacaatcacccaacaagccgggcctgtagagggggctatcctctgtcactgtcacgcacctgattgcatgtctaaactaattaaaactctctgtgctttaggtgatatatttaagatgtaaattagtaacaataaacgtaccttaaatttgacaacagttttctggtgacatcattcagcagcaccactttaccctcttcccagctctcgtatgggatgcgatggtgggcagcaaatttcctccaaaccctaaaagaaatattactgtctacttccttattatttcccacaatcttcatcttttcagagatgaaaagaacccgagttgatgaagacttcaatcccgtctatccatataacacagagccgactccctccgctccctttgttactccgccctttgtttcgtccaatggactcatggaatccccatcaggggtattatccattcgttacacccaacccattactgtagttaacaattccctaagtctaaaaacaggaaatggtttgtctgtgagtagtgatgggaaactgcaaattgccataaacactaacaaaggactaagtaatgaggataacaagattgctgttaaggttggtcctgaactatatttcgacgctgacggtgctatcaccatgaattctcaaactctttggaccaatccgaacgaaactgcaaactgtagcgtctttcaaagcttagactccttattaactttatgtttaactaaaaacggagcccacgtattaggaagcgtaagcttaaccggcctttctggccccctattaaaaatgaccacaacctcagttaccgttcaactaatctttgacagcaacggagtccttactacttcccaacttaatactaactcttggggcatgcgcgcgaacacaaatctaaatgctccagttacaaacgccttaccatttatgcccaacagtactatttatgcaagaggaaacgcaggagaacccagaagcaactactacgtacaaacatacttacgaggcaacctaaataaacaaatcactcttagtatttcattcaacgcttcttcctcaggctactccttaacatttaaatggagtgccattgccacagaaaagtttgccacccctacatcgtcgttctgttacatcgcagaacaataaataccgcactgtttcccttcgtttgcagatgaagcgaacccgaattgaagacgatttcaaccctgtttacccctacgactcagtttctgctccagcagttccatttgtatcccctccatttgtaaacagtgatggtttaaaagaaagtcctcctggagtattaagtttgcaaattgccaaacctctgctctttgatgcgcaaagaaaagtcactctctctttgggtcgaggactagccgttaattcagccggacaactagaaagtacgcaaatcctccaaactaaccctccattgttactatccaacaacatgctttccttagactgtgcttttcccctatctgtagcgaacaaccaactatcccttaaatacacagatccactccgtttagttaatgacagtctcacattcaattttacatctccgcttcatttggctaacggtaaccttacctttagttacacaactcctcttaatattattaacaacagtttagccttaaactattcaccccctctacgacttgtaaacagcaatcttactatggggtacgccgatccatttcaagtggcaaactcaaacctatctctaaaaatcgctaacccttcaggactccgcattcgaaacggtaacttgcaaattgccgctggttatggcttacaaattgcaggtaataacgacctatatgtaagacgagaaacacctctagacgtttacacatctggagcaaaagaaggaatattatacctccggttaggccctaactctggattgcaagttcttagtgacaaccttagtctcaaaaccggtcaaggactgcaaattttgagcaacaccctgtctgttaaactaggacgtggtttacgctttgacagcagcggagccattgaacttagcacatgatgtaataagtttatccaaaaaataaaacatttatttttcagatgaaacgagctcgaattgaggaagacttcaatcctgtgtacccttacgatcccccatatgctcccatcatgccattcattacacctccatttacctcgtctgatggcttgcaagaaaaaccttttggtgttttaagtttaaactacaaaaatccgattactactcaaaatggttctttaactctcaaactaggaaatggcctcaacattaataatcaaggagaactcacctcaacagcaggcgcagtgcaaccccctctcactaatgccgacaacaaattaaccctagcatacagcgagcctttaacagtacaaaacaaacgcctaacgctctcccacagcgcccctctagcggttgctgacaattctttaagtttacaagtcacagaccctattttcataaatgctgacaacaaactagctttacaaacagacgccccacttaacacaactaccggagtccttcgcctgaaaagcgccgcacccttagggcttgtagaacaaaccctaaacctgttgtttgccaaacccttatatttacagggtgacttcctagcattagccattgaacgcccgctagcagtgactgcggacggttcgctagccctggcacttgatccgcccctgaaaaccagtaacacggggttaggactcttaactgccgctccgctcacggttacaaatggaaacctgaacttaaatgttaaacgcccctttgttatacaagacaatagtctttacatggactttagagctccactgcgactgtttaacagcgagccgcaactaggagttaacttcacttcccctcttacggtacgggcagatgccttaacattagacactggaaacggattgcaggtgctttttaacaaactcacattaaatctcggaagagatttggaatatgacaatggagctatagccgttaggttaaacccagctgcccctcttcagtataccaaccagcttcaacttaacctgggagctggcctgcgcttaggtgtttctaagaaattaacagtagatgtggatgaaaataaaggattaacatggaatggtaatcaacttgtggcaagcctaggtactggattagcttttgacaactatggaagaataagtgttgtttcgacagccgctggcgatgatactctgtggacaacggctgacccatcacccaactgtacggtgtatgaacaactagatgctaggctgtggctaagtcttgttaaatgtggcggtatggttcagggaagtgttgctttaaaagccgaaaaaggccgcttgcttaatcccactgcttcttttatttctattgttatgtacttcaatagatatggcgtttggcgcaccgactatcccacaattggtgatgaccaaggcattatagctaacagtgccacatggggatacagacgtggagaatccgccgacacaaacgtcactaacgctttaaaatttatgcctagctcacgaaggtatcctattaaccagggaaataacattcagaaccaaatgattacatacacctgcatacagggagatgttagcatgcctgtgcctttaaaaatcacctttaatcatgcttttgagggttactccttcaaatttacttggcgtgtggtcgccaatcaaaggtttgatattccctgttgttcattttcttacatcacagaagaataaagacaactttcttttttaatttcttttttattttacacgaacagtaagacttcctccccccttccatttgacagcatacaccagcctctcccccttcatggcagtaaactgttgtgagtcagtccggtatttgggagttaaaatccaaacagtctctttggtgatgagacatcgatccgtgatggacacaaatccctggggcaggttctccaacgtttcggtaaaaaactgcgtgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagccttacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgaccgtccaaccttactttaacataaatcaggtgtctgccgcgtacaaacatactacccgcatacagaacttcccggggcaaacccctgttcaccacctgcctgtaccagggaaacctcacatttatcagggagccatagatagccattttaaaccaattagctaataccgccccaccagctctacactgaagagaaccgggagagttacaatgacagtgaataatccatctctcataacccctgatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcaatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaagaatcattaaactaaagaagcttggcgaacggtgggatatatgacacgctccagcagcagacaggcaaccggctgtccccgggaaccgcggtaaaattcatccgaatgattaaaaagaacaacagacacttcccaccatgtactcggttggatctcctgagcacagagcaatacccccctcacattcatatccgccacagaaaaaaagcgtcccagatacccagcgggaatatccaacgacagctgcaaagacagcaaaacaatccctctgggagcaagcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctgaaatccacccaacagcctatagctatatatacactccgcccaatgacgctaataccgcaccacccaccaccaaagttcacccacacccacaaaacccgcgaaaatccagcgccgtcagcacttccgcaatttcagtctcacaacgtcacttccgcgtgccttttcccattcccacacacgcccttcgcccgccccgccctcgcgtcaccgcacgtcaccccggccccgcctcgctcctccccgctcattatcatattggcacgtttccagaataaggtatattattgatgatg

SEQ ID NO: 9 - DNA, 34466 bp, Rhesus Adenovirus 6666 (RhAd6666 / RhAd62) Wild Type
catcatcaataatataccttattctggaaacgtgccaatatgataatgagcggggaggagcgaggcggggccggggtgacgtgcggtgacgcggggtgacgcggggtggcgcgagggcggggcgggtgtgcggaggcgcttagtttttacgtatgcggaaggaggttttataccggaagttgggtaatttgggcgtatacttgtaagttttgtgtagtttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggttcccgagatgtacggtgttttctgcagcgagacggcccggaactcagatgagctgctgaattcagacctgctggaaatttcgaattcgcctgtgcttttgccgccgtcacttcacgacctgtttgatgtggaagtggaccctccggaagatcccaacgaggacgcggtaaatactatgtttccagaatgtctgtttgaggcggctgaggagggttcttacagcggtgaagacggcgggcagggagaggaagtggacctgaagtgctacgaggaatgtctaccttctagcgattctgaaacggaacagacagggggagatggctgtgctgaacctgttgtgaaaaatgaacttgtattagactgtcctgataatcctggtcacggttgccgcgcctgtgattttcatagaaatgccagtggaaatcctgagactctatgtgctctgtgttacctgcgccttaccagccattgtgtatacagtaagtagaaactttttcgctttgtgcatgctggtgggatttttaaagtgcgttgggcttattgttgcgtaatgttttacaggcgacgtgtctgacgcggaaggggatggagatagatcaggctctgctggttctccttgcactttgggggctgtggttccagatggcattattaaacccgtggcggtaagagtttcaggcagacggtgtgcggtcgaaaaaattgaagacttgctgcaggaggaacagatgcaacctttggacctgtccctgaaacgccctaagctgacctaagagtgtttattgtatgcaataaaaagtgttgatctttgaactgtgtttatgtgttgggtgtgtctgtgggtatataagcaggtggatgggaagtgagagcacagctgcttcagatggatctgctaggagacctgagggaatttggcgtggttcggcgcttgctggagttggcctctgacagaacttccaagttttggaggttttgttttggctcaacgcttagcaacgtgctatatagggtcaagaaggagcaggagacgcagtttgctaggctgttggccgatactcctggagtttttgtggctctggatctaggccatcactctcttttccaagagaaaattatcaaaaacttaacttttacgtctcctggtcgcacggttgcttccgctgcctttattacctatattttggatcaatggagcaacagcggcagtcacctgtcgtgggagtacatgctggattacatgtcgatggcgctgtggagggccatgctgcggaggagggtttgcatttacttgcgggcgcagcctccgcggctggaccgagtggaggaggaggacgagccgggggagaccgagaacctgagggccgggctggaccctccaacggaggactaggtgctgaggatgatcccgaagaggggactagtggggctaggaagaagcaaaagactgagtctgaacctcgaaactttttgaatgagttgactgtgagtttgatgaatcgtcagcgtccggagacaattttctggtctgaattggaggaggaattcaggaggggggaactgaacctgctatacaagtatgggtttgaacagttgaaaactcactggttggagccgtgggaggattttgaaaccgccttggacacttttgctaaagtggctctgcgaccggataaggtttacactatccgccgcactgttaacataaagaagagtgtttatgttataggccatggagctctggtgcaggtgcaaaccgccgaccgggtggcctttagttgcggcatgcaaaatctgggccccggggtgataggcttaaatggtgtaacatttcacaatgtaaggtttactggtgaaagttttaacggctctgtgtttgcaaataacacacagctgacgctccacggcgtttacttttttaactttaataacacatgtgtggagtcgtggggcagggtgtctttgaggggctgctgttttcacggctgctggaaggcggtggtgggaagacttaaaagtgtaacatctgtaaaaaaatgcgtgtttgagcgctgtgtgttggctttaaccgtggagggctgtggacgcattaggaataatgcagcgtctgagaatggatgtttccttttgctaaaaggcacggctagcgttaagcataacatgatatgcggcagcggtttgtacccttcgcagctgttaacttgcgcggatggaaactgtcagaccctgcgcaccgtgcacatagcgtcccaccagcgacgcgcctggccaacattcgagcacaatatgcttatgcgctgtgccgttcacctgggccctaggcgaggcgtgtttgtgccttaccagtgtaactttagccataccaagtttttactagaacctgacaccttctctcgagtgtgtttcaacggggtttttgacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatttcggcgctcaagttgtcagtttctacaaacgaggaggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggtggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggatttaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatttcgtcgaagccgttaatgttgtggcccacgatgtaaagttccataaagcgcggctgtcccttgagggccggcgcttttttcaactcctcgtaggtgagacagtccggcgaggagagacccagctcagcccgggcccagtcggagagttgaggattagccgcgaggaaggaactccatagatccaaggccaggagagtttgcaagcggtcgcggaactcgcggaactttttgcccacggccattttctccggtgtcactacgtaaaaagtgtcggaccggtcgttccagacgtcccatcggagctctagggccagctcgcaggcttggtgaacgagggtttcctcgcccgagacgtgcatgaccagcataaagggtaccagttgtttcccgaacgagcccatccatgtgtaggtttctacgtcgtaggtgacaaagagccgctgggcgcgcgcgtgggagccgatcggaaagaagctgatctcctgccaccagctggaggaatgggtgttgatgtggtggaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatcccattcgccttggcggtgggagtttgcgtctgcgtccttcttctctgggtggacgacggtggggacgacgacgccccgtgtgccgcaagtccagatctccgccacggaggggcgcaggcgctgcaggaggggacgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgtcgtctctgcgtgaataccaccggcccccgggtcctgaacctgaaagagagttccacagaatcaatgtctgcatcgttaacggcggcctgcctgaggatctcctgtacgtcgcccgagttgtcctgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttaagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggctcgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctctcggccagcacggcctgttggatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggcgcgggactcgaacacgtagtcgttgcatgtgcgcaccagatactggtagccgaccagaaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggtggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggaacccgagggtcgctggctcttggatctgattaatatcctgcagagcatcgtggtgcaggagaggggtctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacacacgagaaagtcctgactatcgtgaacgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaacttgcaaggcatgtggggcgtcaaggccccggtgggcgatcgagccaccatctccagtctgctgacccccaacactcgcctgctgctgctcttgatcgcgccgttcaccaacagtagcactatcagccgtgactcgtacctgggtcatctcatcactctgtaccgcgaggccatcggtcaggctcagatcgacgagcatacatatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgcgtccgatagcattttcacgccggctaatcgccgattccagaagaaggagggcggagacgagctccccctctccagcgtggaggccgcctctaggggagagagcccctttcccagtctgtcttccgccagtagcggtcgggtcacgcgcccgcggttgccgggggagagcgactacctgaacgaccccttgctgcgaccggctaggaagaaaaatttccccaacaacggggtggaaagcttggtggataaaatgaatcgttggaagacctacgcccaggagcagagggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaagggcgttcgagtcgcctgtactaataaaaaagaagcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggattagaaagcgccgccccttccaagagggctttcagatcatgtatgaggacctggagggaggtaatatacccgccctactggacgtgtcaaagtatgaggacagcgtgaagaaggcggaagctcagggacgagaaattcggggcgacacatttgcggtggcaccccaagacctggtgatagagcctttgactaaagacagcaaaaacagaagctacaacattattaccggtactatggacaccaaatatcggagctggtttctggcttacaactacggggatcccgaaaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtctaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgccagcatggccagacccaggagagggaacgtgtactgggtgcgcgattctgtgacgggagtccgcgtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaattaagagagaaatggaagatctgcatcccaccatccaactcatggtccctaaacggcagaggctggaagaggtcctggagaagatgaaagtggaccccagcatagagccggatgtaaaagtcagacctattaaggaagtggcccccggtcttggggtgcaaacggtggacattcaaatccccgtcaccaccgcttcaaccgccgtggaagccatggaaacgcaaacggaaacccctgccgcgatcggtaccagggaagtggcgttgcaaacggagccttggtacgaatacgccgcccctcggcgtcagaggcgacccgctcgttacggccccgccaacgccatcatgccagaatatgcgctgcatccgtctatcctgcccacccccggctaccggggagtgacgtatcgcccgtctggaacccgccgccgaacccgtcgccgccgccgctcccgtcgcgctctggcccccgtgtcggtgcgccgcgtaacacgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggagagcaaggagcctccctcgtacgagcaagctttaaaagagggcgcctctccaccctcctacccgatgactaagccgatcgcacccatggctcgaccggtgtacgggaaggattacaagcccgtcacgctagagctccccccgccgccaccgccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggtgctccaaacccatcagagtggaacggaactgacagcaaaaccaatgtcagaggtcaagcaccattcattagtgatgcaataactaaagagggcataaaagttggtacagacacaggaaaccccggacaagcaatttatgctaaaaaagagtatcagcctgaaccccaagtgggggaaacgcaatggaatagcgacgttggagcaacagacaaagcggcaggacgaattttaaagaaaacgacacccatggttccgtgctatgggtcttatgccaaacccacaaacgaagaagggggtcaggctacaaaccagcaggtagatatgcagttttttgctaccggcagttctaatactacaccaaaggttgtgctgtactctgaagacgtgacgattgagacgcccgacacccacttagtatttaagccaattgtaacagcaggaaccacaaatgcagaagctttgttagcgcagcaagctgctcccaatcgaccaaactacattggctttagagataattttattggtcttatgtactacaacagcactggaaacatgggagtgctggctgggcaggcttcgcagttaaacgctgtggttgatttgcaagacagaaacactgagctatcttatcaactaatgctggatgctttgggggatagaagcagatacttttcaatgtggaatcaagcggtggacagttacgatcccgatgtgagaattgtagaaaaccacggagtagaggacgagttaccaaattactgtttcccgttaggcggtatggcagtaactgatacctacacaggtattaaacctgataatggaggcactacattctcaaatgatgacacttttgcaactagaggaatagaaataggttctggaaacatgttcgccatggagattaatctgcaggctaatctgtggcgtagtttcttgtattccaacatcgggctgtaccttccagacaccttgaaaatcactcccgacaacataacgttgccggacaacaaaaacacctaccagtacatgaatggtcgtgtcactccccccgggcttgtggacacctacgtgaacgtgggtgcgcgctggtcccccgacgtcatggacggcattaaccccttcaaccaccaccgcaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcagctaacatgctgtaccccatccccgccaatgccaccagcgtgcccatctctattccttctcggaactgggctgccttcaggggctggagttttactcgcctcaaaaccaaggagactccctcgctgggctccggttttgacccctacttcgtctactccggctccatcccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggttcctaattcaaatgctcagtcactataatataggttaccagggcttctatgtgcccgagaactacaaggaccgcatgtactccttcttccgcaacttccaaccaatgagccggcaggtggtagataccgtgacttatacagactacaaggatgtcaagctcccctaccaacacaacaactcagggttcgtgggctacatgggacccaccatgcgagaggggcaggcctaccccgccaactacccctatcccctgattggggccaccgccgtgcccagcctcacgcagaagaagttcctctgcgaccgggtgatgtggaggatccccttctctagcaactttatgtcgatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcctaacagcatgcttcacagcccccaggtcgcccccaccctgcgccgtaaccaggaacacctgtatcgctttttggggaaacactctgcctactttcgccgccaccggcagcgcattgaacaggccacagcctttgaaagcatgaaccaaagagtgtaatcaataaaaaaaccattttattttaacatgacacgcgcttctggcgttttttattaaaaatcgaagggttcgagggaggtgtcttcgtgcccgctggggagggacacgttgcggtactggaaacgggcgctccaacgaaactcggggatcaccagccgcggcagaggcacgtcttccaggttctgcttccaaaactgccgcaccagctgcagggctcccatcacgtcgggcgccgatatcttgaagtcgcagttagggccggagctcccgcggctgttgcggaacacggggttggcacactggaacaccatcacgctggggttgtggatactagccagggccgtcgggtcggtcacctccgacgcatccagatcctcggcgttgctcagggcgaacggggtcagcttgcacatctgccgcccgatctggggcaccaggtcgggtttgttgaggcaatcgcagcgcagagggatgaggatgcgacgctgcccgcgctgcatgatagggtaactcgctgccagaaactcctccatctgacggaaggccatctgggccttcgtgccctcggtgtagaatagcccgcaggacttgctagagaatacgttattgccgcagttgatgtcttccgagcagcagcgggcgtcttcattcttcagctgaaccacgttgcgaccccaacggttctggaccaccttggctctagtggggtgctccttcagcgcccgctgcccgttctcgctggtcacatccatttccaccacgtgttccttgcagaccatctccactccgtggaagcaaaacaggacgccctcccgctgggtattgcggtgctcccacacggcgcacccggtgggctcccagctcttgcgtttcacccccgcgtatgcttccatgtaagccatgaggaatctgcccatcagctcggtgaaggtcttctggttggtgaaggttagcggcaggccgcggtgctcctcgtttaaccaagtttgacagatcttgcggtacacgactccctggtcgggcagaaacttaaaagccgctctgctgtcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttgaaactccacggtgccgtccgcgcggcgtactctgcgcaccggagggtagctgaagcccacctccaccacggtgccttcgccctcgctgtcggaaacgatctccggggatggcggcggcggcgcgggtgttgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgtcgagatttccttttgaaaaagggtcggggggtgtacctagacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgtcagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcacctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggagccgatcgtcttcagctactttgagctgccggacgagcaccctcagggaccggctcacgggttgaaactcgagatcgagaacgcgctcgagtctcgcctcatcgacgccttcgccgcccggcctctcctggtagaaaccgaacgcgggaccactaccatcaccctgttctgcatctgccccacgcccggattacatgaagatctgtgttgtcatctttgcgctcagtttaataaaaactgaactttttgccgcaccttcaacgccatctgtgatttctacaacaaaaagttcttctggcaaaggtacacaaactgtattttattctaattctacctcatctatcgtgctgaactgcgcctgcactaacgaacttatccagtggattgcaaacggtagtgtgtgcaagtacttttgggggaacgagatagttagtagaaataacagcctttgcgagcactgcaactcctccacactaatcctttatcccccatttgttactggatggtatatgtgcgttggctccggtttaaatcctagttgctttcataagtggtttctacaaaaagagacccttcccaacaattctgtttctttttccaccctgtcctactgctgttctccctctggttactctttcaaacctctaattggtattttagctttgatactgataatctttattaactttataataattaacaccttacagtaaacatgcttgttatcctcctgctcgccacatttttcgctctctctcacgccagaacaagtattgttggcgcaggttacaatgcaactcttcaatctgcttacatgccagattccgaccagataccccatattacgtggtacttacaaacctccaaacctaattcttcattttatgaaggaaacaaactctgcgatgactccgacaacaggacgcacacatttccccacccttcactacaattcgaatgcgtaaacaaaagcttgaagctttacaacttaaagccttcagattctggcttgtatcatgctgtagttgaaaaaagtaatttagaagtccacagtgattacattgaattgatggttgtggacctgccacctccaaaatgtgaggtttcctcctcttaccttgaagttcaaggcgtggatgcctactgcctcatacacattaactgcagcaactctaaatatccagctagaatttactataatggacaggaaagtaatcttttttattatttaacaacaagcgctggtaacggtaaacagttacctgattattttactgctgttgttgaattttccacctacagagaaacgtatgccaagcggccttacaatttctcatacccgtttaacgacctttgcaatgaaatacaagcgctcgaaactggaactgattttactccaattttcattgctgccattgttgtgagcttaattaccattattgtcagcctagcattttactgcttttgcaagcccaaaaaacctaagtttgaaaaacttaaactaaaacctgtcattcaacaagtgtgattttgttttccagcatggtagctgcatttctacttctcctctgtctacccatcattttcgtctcttcaactttcgccgcagtttcccacctggaaccagagtgcctaccgccttttgacgtgtatctgattctcacctttgtttgttgtatatccatttgcagtatagcctgcttttttataacaatctttcaagccgccgactatctttacgtgcgaattgcttactttagacaccatcctgaatacagaaatcaaaacgttgcctccttactttgtttggcatgattaagctattgctgatacttaattatttacccctaatcaactgtaattgtccattcaccaaaccctggtcattctacacctgttatgataaaatccccgacactcctgttgcttggctttacgcagccaccgccgctttggtatttgtatctacttgccttggagtaaaattgtattttattctacacactgggtggctacatcccagagaagatttacctagatatcctcttgtaaacgcttttcaattacagcctctgcctcctcctgatcttcttcctcgagctccctctattgtgagctactttcaactcaccggtggagatgactgactctcaggacattaatattagtgtggaaagaatagctgctcagcgtcagcgagaaacgcgagtgttggaatacctggaactacagcaacttaaagagtcccactggtgtgagaaaggagtgctgtgccatgttaagcaggcagccctttcttacgatgtcagccttcagggacatgaactgtcttacactttgccttcgcaaaaacaaaccttctgcactatgatgggctctacctccatcacaatcagccaacaaaccggacctgttgagggagctatcctgtgtcactgtcatgcgcctgattgtatgcccaaactaattagaactctctgcgccttatgtgatatatttaagatgtgaatcgggatcaataaacttaccttaaatttgacagcagttttctggtaacatcattcagcagcaccactttaccctcttcccaactctcgtatgggacgtgatggtgggcggcaaacttcctccaaaccctaaaacaaacattaatatccacttccttgtccttacccacaattttcatcttttcatagatgaaaagaaccagagttgatgaagacttcaaccccgtctacccttatgactccacatccactcctgcggtcccctttatatcccccccgtttgtaaacagcgatggtcttcaggaaaaccctcctggagtcttaagtttacgaatagctaaacccttgtattttgacatggaaaggaaactagcgctttcacttggaagaggattggcaattacctccaccggacagctagaaagcacacagagcgtgcaaaccacccctccattagttgtcaataacagcaacacgcttgtcctgcgttattcctccccgttaggcttatcgggtgacaatttaatactaaattgctccgatcctctccgcgtaataaacaacagcctcacattcagctacctatctccacttcgttttgaaggtggcagtcttacattcaattacacatctccccttaaactgttgaacagcagccttgcgatcggaataaattccaacaaaggtctcggcaatgacagcgatgaactttctgtcaaactaacatcagatctgaagtttaacaacgatggaaaaatagcttttggtatacaaagcctgtgtaccacccccacagccgcctctaactgtaccgtttttaccaacggtgattctttactctgtttatgtttaaccaaatgtggagctcacgtgttaggaagtgtgagtttaaccggaatgcaaggaaccataacagccatgacacagaactacattagtattcaatttctatttgaccacaatggtgcgttgacttcatcaccgctcctcaacaacaacacttggggtatacggcaaagcgacacttcgtccgctaaccccgcctacaatgctcttgcatttatgcctaacagcactgtatatgtaagaggtcaaagtggtgagcccagaaataactattacacccaaacataccttaggggaaacgttaaaaagccaattatccttaccgttacctacaactcggctgcttcaggttattcactaacttctaaatgggatgctgtggtaacagaaaaatttgccactccaacatcttctttttgctatattacagaacaataaattcctattaccccaccaattcgtttttttcagatgaaacgggccagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacggctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggtgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaataaagaacaactttttttaaatttcatttttattttacacgcacggtaaggcttcctccacccttccatttgacagcatataccagcctctcccccttcatggcagtaaactgttgtaagtcagtccggtatttgggagttaagatccaaacagtctctttggtgatgaaacgtggatccgtgatggacacaaatccctgggacaggttctccaacgtttcggtaaaaaactgcgtgccgccctacaaaacaaacaggttcaggctctccacgggttatctccccgatcaaactcagacagggtaaaggtgcggtgatgttccactaaaccgcgcaggtggcgctgtctaaacctctcggtgcgactcctgtgaggctggtaggaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcaaacccctgttcaccacctgcctgtaccagggaaacctcacatttatcagggagccatagatagccattttaaaccaattagctaacaccgccccaccagctctacactgaagagaaccgggagagttacaatgacagtgaataatccatctctcataacccctgatggtctgatggaaatccagatctaacgtagcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaatgcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagagatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgcgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaaacgtcccagatacccagcgggaatatccaacgacagctgcaaagacagcaaaacaatccctctgggagcaatcacaaaatcctccggtgaaaaaagcacatacatattagaataaccctgttgctggggcaaaaaggcccggcgtcccagcaaatgcacataaacatgttcatcagccattgccccgtcttaccgcgtaaacagccacgaaaaaatcgagctaaaatccacccaacagcctatagctatatatacactccgcccaatgacgctaaaaccgcaccacccacgaccaaagttcacccacacccacaaaacccgcgaaaatccagcgccgtcagcacttccgcaatttcagtctcacaacgtcacttccgcgcgccttttcacattcccacacacacccgcgcccttcgacccgcccgccctcgcgccaccccgcgtcaccccgcgtcaccgcacgtcaccccggccccgcctcgctcctccccgctcattatcatattggcacgtttccagaataaggtatattattgatgatg

SEQ ID NO: 10 - DNA, 35052 bp, Rhesus Adenovirus 6668A (RhAd6668A / RhAd63) Wild Type
catcatcaataatataccttattctggaaacgtgccaatatgataatgagcggggaggagcgaggcggggccggggtgacgtgcggtgacgcggggtgacgcggggtggcgcgagggcggggcgggtgtggggaggcgcttagttttcacgtatgcggaaggaggttttataccggaagttgggtaatttgggcgtatacttgtaagttttgtgtaatttggcgcgaaaaccgggtaatgaggaagttgaggttaatatgtacgttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggttcccgagatgtacggtgttttctgcagcgagacggcccggaactcagatgagctgcttaatacagatctgctggatgttcccaactcgcctgtgacttcgcttccgtcgcttcatgatcttttcgatgtggaagtggatccaccgcaagatcccaacgaggacgcggtaaacagtatgttccctgaatgtctgtttgaggcggctgaggagggttctcacagcagtgaagagagcaaacggggagaggaactggacttgaaatgctacgaggaatgtctgccttctagtgattctgaaacggaacaaacagggggagactgctgtactgagccggtagtgaaaaatgaacttgtattagactgtcctgatcaacctggtcatggctgccgtgcctgtgcttttcatagaaatgccagcggaaatcctgaaactctatgtgctctgtgttacctgcgtcttaccagcaattttgtatatagtaagtaggagctttttcgatttgcgcatggtggtgggattgttaaagtgtgttgggcttattgtttgtgtaatgttttacaggtgacgtgtctgacgcggaaggggacggagatagatcagggtctgctaattctccttgcactttgggggctgtggttccagttgacattattagacccgtggcggtcagagtatcaggcagacggtgtgcagttgaaaaattggaagacttgctgcaggaagaacagacggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcttatattttggatcaatggagcaacagcgacagccacctgtcgtgggagtacatgctggattacatggcgatggctctgtggagggccatgctgcggaggagggtttgcatttacttgcgggcgcagcctccgcggctggatcgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttatcggccatggagctctggtgcaggtgcagaccccagaccgggtggctttcaattgcggcatgcagagtttgggccccggggggataggtttgaatggagttacatttcaaaatgtcaggtttactggtgatgattttaatggctctgtgtttgtgactagcacccagctaaccctccacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgtgccgttcacctaggtgctagacgcggcgtgtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagccacgaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacaaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttttcggcccggtagaggatctgcctgaagatggcgtgggagttggaagagatggtggggcgttggaagacgttaaagttggctccgggcagtcccacggagtcttggatgaactgggcgtaggattcccggagcttgcccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccattggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagcggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtgtcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacagtgggtcgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcatgccgggttgggtgatctccgtgtacttgaggcgcgagtaggcgcgggactcgaacacgtagtcgttgcatgtgcgcaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcggccctggtgaattcccggacgcggttccagatgttgcgcagggggcggaagcgttccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacgcacgagaaagtcctgactatcgtgaatgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgtgactcgtacctgggtcatctcatcactttgtaccgcgaggccatcggtcaggctcagattgacgagcatacatatcaggagatcactaacgtgagccgggccctgggtcaggaagataccggcagcctggaagccacgttgaactttttgctaaccaaccggaggcaaaaaataccctcccagtttacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggcgagtttgacctgcccgaagccgacgacggctttctttgggacgacgtgtccgacagcattttcacgccgggcaatcgccgattccagaagaaggagggcggagacgagctccccctctccagcgtggaggcggcctctaggggagagagtccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaactcggcagccccgatacgagtggttcgagtttaccattccagagggcaactattccgaaactatgactatcgatctcatgaataacgcgatcgtggacaattacctgcaagtggggagacagaacggggtgctggaaagcgatatcggcgtgaaattcgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttaggaattagaaagcgccgcccattccaagagggctttcaaatcatgtatgaggacctggagggaggtaatatacccgccttactggacgtgtcgaagtacgaagctagcatacaacgcgccaaagcggagggtagagagattcggggagacacctttgcggtagctccccaggacctggaaatagtgcctttaactaaagacagcaaagacagaagctacaatattataaacaacacgacggacaccctgtatcggagctggtttctggcttacaactacggagaccccgagaaaggagtgagatcatggaccatactcaccaccacggacgtgacctgtggctcgcagcaagtgtactggtccctgccggatatgatgcaagacccggtcaccttccgcccctccacccaagtcagcaacttcccggtggtgggcaccgagctgctgcccgtccatgccaagagcttctacaacgagcaggccgtctactcgcaacttattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtggtggctcctaaagttctttctagtcgcaccttctaaaaacatgtccatcctcatctctcccgataacaacaccggctggggactgggctccggcaagatgtacggcggagccaaaaggcgctccagtcagcacccagttcgagttcggggccacttccgcgctccttggggagcttacaagcgaggactctcgggtcgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggcaggcagaagggctatgcgccgcgctgccgccaacgccgccgccgggagggcccgccgacaggctgcccgccaggctgctgctgccatcgctagcatggccagacccaggagagggaacgtgtactgggtgcgtgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgttacgtcagcttcaaccgccgtggaagccatggaaacgcaaaccgaaacccccgccgcggttggtacgaaagaagtggcgttgcaaaccgacccctggtacgaatttgccaccccccggcgtcagaggcgacccgctcgttacggccccgccaatgccatcatgccagaatatgcgctgcatccgtctatcctgcccacccccggctaccggggagtgacgtatcgcccgtcgggaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgcagccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgagggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcctggaacccgcgtaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacaaccccatggagcgcaaccccaccatggatctgctcaccggagtgcccaacagcatgcttcacagcccccaggtcgcccccaccctgcgccgtaaccaggaacacctgtatcgctttctggggaaacactctgcctatttccgccgccaccggcagcgcatcgagcaggccacggcctttgaaagcatgagccaaagagtgtaataaataaaaaccatttttatttaacatgatacgcgcttctggcgtttttattaaaaatcgaacggttcgagggaggggtcctcgtgcccgctgggaagggacacgttgcggtactggaaacgggcgctccaacgaaactcggggatcaccagccgcggcaggggcacgtcttctaggttctgcttccagaactgccgcaccagctgcagggctcccatgacgtcgggcgccgagatcttgaagtcgcagttagggccggagcccccgcggctgttgcggaacacggggttggcacactggaacaccagcacgctggggttgtaaatactggccagggccgttgggtcggtcacctccgacgcatccagatcctcggcattgctcagggcgaacggagtcagcttgcacatctgccgtccgatctggggcaccaggtcgggtttgttgaggcaatcgcagcgcagagggattaggatgcgacgctgcccgcgttgcatgatagggtaactcgccgccaggaactcctccatctgacggaaggccatctgggccttggtaccctcggtgaaaaatagcccacaggacttgctagaaaatacgttattgccgcagttgatgtcttccgcgcagcagcgtgcatcttcgttcttcagctgaaccacgttacgcccccagcggttctggaccaccttggctttcgtaggatgctccttcaacgcccgctgaccgttctcgctggtcacatccatttccaccacgtgctccttgcagaccatctccactccgtggaagcagaacaggacgccctcctgctgggtattgcgatgctcccaaacggcacatccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagccgctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttggaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagtgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcagccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaactctcggagaaaaaagctaaggcctcctctgccgcgaggaaaaactccgccgccgctgccgccgccaaggatccgccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcattgccagcatgagcaaggagattcccaccccttacatgtggagctatcagccccagatgggcctggccgcgggggccgcccaggactactccagcaagatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttttccggctcacctggacgctacccggacgccttcattcccaactttgacgcagtgagtgaatccgtggacggctacgactgatgacagatggtgcggccgtgagagctcggctgcgacatctgcatcactgccgccagcctcgctgctacgctcgggaggcgatcgtgttcagctactttgagctgccggacgagcaccctcaggggccggctcacgggttgaaactcgagatcgagaacgcgctcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaacgaactaattcagtggtttgctaacagttcactctgtaaagtatttcttaattctaaggtttttcctggattcggcagttcctcgtgtggaaacgttacccattcctccttaactgtctcagcgcctttttcagaaatccaatatttctgtattggagcaggaggtgaagcgggttgcgttcaccgttcgtttcttaaacgatttgttgctgttcctgttaacacctccctttcatctcattcttacttcatttacccccctgctcaccactcttggcaaccccttattggcctaacagctttcattaccatagttttacttaactttataatcattaacagactttcttaaaaaatgctgataattttgcttattactttcactcttgctgctgcttcccccaaatcaaatgatggttttatagacgtatatgctaaacaagggacaaacttacttatgcaatctcactatgcacctccagacgttattacacatattgcttggtacttagatgtttttcagggcattttcgacacaactataccttcatattttacgggggttaagctttgtgaaagctcaccacttcaagaacaggaatggtttcacccacctctacaatttcattgcataaacaatagcctacacttgtacaatctgaaacctagcgatgctggtgtttataatgctaaagttttttcagattccattgaacataatacatactttcaactacatgtgatttcttttccaaaacctaactgtaacattaactctacttacctaacaaacgactactgccttattaacatcgactgttccaaattatcatacccggccaaagtttattttaatggtaatcaaagtaaacttcattactatttatctgcacgcggaggcaacggaaaccttccagattattttactgttggctatgaatacagagacctcaaacaaaattatacagttcactatccattcaatgacctttgtgcagaaataaccgctcttgaaacggggtctgatttcacccctatctttatagttaccatagcggttagtgttatagttataattttagccattacatacttcatctaccactgtagaactttaaaaaaaaccaagaaaaacaagcctcctgaaatccgtttgctttaattttttccagaatggtagctgctttcttcattcttctctgtataccaatcatctgcgcctccacaacttttgctgctgtttcccacctggaaccagactgtctacaaccttttgttgtatacctaatactgacttttgtggtctgcacggccattaccagtatagcctgcttttttgtaacaattttccaagccgccgattacctctacgtacggtttgcttattttagacatcaccccgagtatcggaatcaaaacgtagcttctctgctttgtttagcatgattcgcatttttatactttgtaagctctttaccctcacaacatgtcattgtccttttaccaaaccctggtccttttacacttgttataatgtattgcccgaaacccctattgcctggctttacgtagccacagcggttttagtttttgcagcaacctgcattggagttaaactgtacttctacttaaagattggatggcttcatcccccagaagatttaccccgatatcctcttgttaataactttcaacagcctctgccgcctcctgatcctcttccgcgagctccctccgttgttagctactttcaactcaccggtggagatgactgactctcaagacattgatattaatgtggaaagaatagctgctcagcgtcagcgagaaacgcgggtgctggactaccttgaactacagcagcttaaagagtcccactggtgtgagaaaggagtgctgtgccatgttaagcaggcagccctttcttacgatgtcagcctccagggacatgaactatcttacactttgccttcgcaaaaacaaaccttctgcaccatgatgggccctacctccatcacaatcacccaacaaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatccagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactatgccaatttttttccaagtccagtacaattatgtaaccactggatattccttcaaattcacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgttgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggcgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcagagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccaccaccaaagttcgcccacacccacaaaacccgcgaaaatccagcgccgtcagcacttccgcaatttcagtctcacaacgtcacttccgcgcgccttttccctttcccacacacgcccttcgcccgccccgccctcgcgccaccccgcgtcaccccgcgtcaccgcacgtcaccccggccccgcctcgctcctccccgctcattatcatattggcacgtttccagaataaggtatattattgatgatg

SEQ ID NO: 11 - DNA, 35213 bp, Rhesus Adenovirus 6668B (RhAd6668B / RhAd64) Wild Type
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgamytttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggttcccgagatgtacggtgttttctgcagcgagacggtccggaactcagatgagctgcttaatacagatctgctggatgttcccaactcgcctgtggcttcgcctccgtcgcttcatgatcttttcgatgtggaagtggatccaccgcaagatcccaacgaggacgcggtaaacagtatgttccctgaatgtctgtttgaggcggctgaggagggttctcacagcagtgaagagagcaaacggggagaggaactggacttgaaatgctacgaggaatgtctgccttctagtgattctgaaacggaacagacagggggagactgctgtactgagccggtagtgaaaaatgaacttgtattagactgtcctgatcaacctggtcatggctgccgtgcctgtgcttttcatagaaatgccagcggaaatcctgaaactttatgtgctctgtgttacctgcgtcttaccagcgattttgtatatagtaagtaggagctttttcgatttgcgcatggtggtgggattgttaaagtgtgttgggcttattgtttgtgtaatgttttacaggtgacgtgtctgacacggaaggggacggagatagatcagggtctgctaattctccttgcactttgggggctgtggttccagttgacattattagacccgtggcggtcagagtatcaggcagacggtgtgcagttgaaaaattggaagacttgctgcaggaagaacagacggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcctatattttggatcaatggagcaacagcaacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttatcggccatggagctctggtgcaggtgcagaccccagaccgggtggctttcaattgcggtatgcagagtttgggccccggggtgataggtttgaatggagttacatttcaaaatgtcaggtttactggtgatgattttaatggctctgtgtttgtgactagcacccagctaaccctccacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgtgccgttcacctaggcgctagacgcggcgtgtttatgccttatcaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacaaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttttcggcccggtagaggatctgcctgaagatggcgtgggagttggaagagatggtggggcgttggaagacgttaaagttggctccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgtctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccataacggaccagttgacgacttgcatgccgggttgggtaatctccgtgtacttgaggcgcgagtaggcgcgggactcgaacacgtagtcgttgcatgtgcgtaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggctgcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgcctcaccacggacgtgaaggaggcgctggctcagaaggagcgctttctgagggacagcaatctgggttctctggtggcactcaacgccttcctgagcacgcagccggccaacgtgccccgcgggcaggaggactacgtgagcttcattagcgctctgaggctgctggtgtccgaggtgccccagagcgaggtgtatcagtccggaccggattacttttttcagacgtcccgccagggcttgcaaacggtgaacctgactcaggcctttaaaaacttgcaaggtatgtggggcgtcaaggccccggtgggcgatcgcgccaccatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagtcgggctctgggtcaggaagacaccggcagcttggaagccacgttgaactttttgctgaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcctcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaacccaacagccccgatacgagtggtttgagtttactattccagagggcaactactccgagaccatgactatcgatctaatgaataacgcgatcgtggacaattacctgcaagtggggaggcagaacggggtattggaaagcgatatcggtgtgaaatttgataccagaaacttccgactggggtgggatcccgtgaccaagctggtgatgccaggcgtgtacaccaacgaggcttttcaccccgacatcgtgctgcttccggggtgtggtgtggactttactcagagccgcttgagtaacctgttaggaatcaggaagcgccgtcccttccaggagggctttcaaatcatgtatgaggacctggagggaggtaacattccaggcttgctagacgtgccggcgtatgaacaaagcttacagcaagcccaagaggaggggcgagtaactcgcggagacacctttgctacggctccccatgagttggtgattcagcctttaacgaaagacagtaaaaacagaagttacaaccttatacccaactctacggatacactgtaccggagctggttcctggcttacaactacggcgatcccgagaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtccaccgcgcttacccacgtgttcaatcgctttcccgagaaccagattttggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctcgggccgaacggcggtagacgataccatagatgccgtgattgccgacgcccgccggtacaatcccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgcctccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgctttagacagcggcaaccccacgcccagcctcaaacctgtgacgctgcagcaggtgctccccgtgagcgccagcacggacagcaagaggggaataaaaagagaaatggaagatctgcagcccaccatccagctcatggtccctaaacggcagaggctggaagaggtcctggagaaaatgaaagtggaccccagcatagagccggacgtcaaagtcaggccgatcaaagaagtggcccctggtctcggggtgcagacggtggatatccagatccccgtcacgtcagcttcgaccgccgtggaagccatggaaacgcaaacggaaacccctgccgcgatcggtaccagggaagtggcgttgcaaaccgacccctggtacgaatacgccgcccctcggcgtcagaggcgacccgctcgttacggccccgccaacgccatcatgccagaatatgcgctgcatccgtctatcctgcccacccccggctaccggggagtgacgtatcgcccgtcaggaacccgccgccgaacccgtcgccgccgccgctcccgtcgtgctctggcccccgtgtcggtgcgccgcgtaacacgccggggaaagacagttaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaatggggtggtgaccggcatccacggcgcggtagatctcgccaaccaagcggtgcagaaagagattgacaggcgtttggaaagctcgcgggtgccgccgcagagaggggatgaggtggaggtcgaggaagtagaagtagaggaaaagctgcccccgctggaaaaagttcccggtgcgcctccgagaccgcagaagcggcccaggccagaactagaagagactctggtgacggagagcaaggaacctccctcgtacgagcaagccttgaaagagggcgcctctccaccctcctacccgatgactaagccgatcgcacccatggctcgaccggtgtacggcaaggattacaagcccgtcacgctagagctccccccaccgcccccttcgcgtccgacggtgcctccgctgcctgccccgtcggcgggtcccgtgtctgcaccatccgctgtgcctctgccggccgcccgtcccgtggccgtggccactgccagaaaccccaaaggccagagaggagccaactggcaaagcacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagctttaagccctactccggaaccgcttacaactccctggctcccaagggtgctcccaaccctgcagaatgggaaaattctgacaacaagctaaaagtgagggctcaggcgccttttgttagctcttacggtgccactgcaattacaaaggatggtattcaagttggagtagtattaacagactcgacacagacgccacagtatgcggataaaacgtatcagcctgagccgcaaattggggaactacagtggaacagcgaagtgggaaacgatgataaagtagcaggcagggttctaaagaaaacaacacctatgtttccttgttacggttcatatgccaagcctaccaacgacaaaggagggcaggcaacacagcccgctgctggtcaagacgctcagaatgcagtagaattacagttctttgctactactagcgccaccaccactccaaaagcggtgttatacgctgaggatgtgtccattgaaacaccagacacccaccttgtgttcaagccaacagtaactgcgggaactacaagttcagaagctttgctgtcccaacaagccgctcccaaccgaccaaactacattgccttcagagataactttatcggccttatgtactacaacagcacgggaaacatgggagtactggccggtcaggcatcccagttaaatgccgtggttgatttgcaagacagaaatactgaactgtcatatcagctaatgttggacgcgctgggagaccgcagtcgctacttctctatgtggaaccaagctgttgacagttacgatccagatgtgagaatagtggaaaatcacggcgtagaagatgaattgccaaattattgctttccattgggcggaacggtagttacggatacctacacgcccatacagccaaatagcaatggaggaggcacatgggttgcaaaagataacgtttttacagatagaggagtggaaataagctcaggtaatatgtttgccatggaaattaacctacaagccaacctctggcgcagctttttgtattccaatattggattgtacctcccagacaccctgaaaataacccccgacaacattacgctgccagagaacaaaaacacctaccagtacatgaacggacgggtaacgccgcccggactcgtggacacctacgttaacgtgggcgcgcgctggtcccccgatgtcatggacagcatcaaccccttcaaccaccaccgcaacgccgggctccgctaccgttccatgctccttggcaacggccgctacgtgcccttccacattcaggtgcctcagaaattctttgccattaagaacctgttactgctccccggttcctacacctacgagtggaacttccgcaaggacgttaatatgatcttgcagagctcgctgggcaatgacctgcgagtggacggggcgagcatccgcttcgacagcattaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcgtcggtcagctggcccggcaacgaccgtctgctgacgcccaacgagttcgaaatcaagcgttcggtggacggtgaagggtacaacgtggcccagagcaacatgaccaaggactggttcttaattcagatgctcagccattacaacatcggctaccagggtttctacgtgcccgagaattacaaagaccgcatgtactccttctttagaaacttccaacctatgagccgtcaagtagtagatactgtggcttataaggactactatcaggacgttaagctcccctaccagcacaacaactcagggttcgtgggctacatgggacctaccatgcgagaggggcaggcctaccccgccaactacccctatcccctgattggggccaccgccgtgcccagcctcacgcagaagaagttcctctgcgaccgggtgatgtggaggatccccttctctagcaactttatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcttggaacccgcgcaaccgcacctgctacctgtttgacccttttgggttttccgacgaaaggctgaagcagatctaccagttcgagtacgaggggctccttaagcgcagcgctctggcttccaccccagaccactgcgtcaccctggaaaagtccacccagacggtccaggggcccctctcggccgcctgcgggctcttctgttgcatgtttctgcacgccttcgtgcactggcctcacacccccatggatcacaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgagcaggccacggcctttgaaagcatgagccaaagagtgtaatcaataaaaccatttttatttaacatgatacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccagaactgccgcaccagctgcagggctcccatcacgtcgggcgccgatatcttgaagtcgcagttagggccggagctcccgcggctgttccggaacacggggttggcacactggaataccatcacgctggggttgtggatactagccagggccgtcggatcggtcacctccgacgcatccagatcctcggcgttgctcagggcgaacggggtcagcttgcacatctgccgcccgatctggggcaccaggtcgggtttgttgaggcaatcgcagcgcagagggatcaggatgcgacgctgcccgcgttgcatgatagggtaactcgccgccaggaactcctccatctgacggaaggccatttgggccttggtgccctcggtgaaaaatagcccacaggacttgctagaaaatacgttattgccgcagttgatgtcttccgagcagcagcgtgcatcttcgttcttcagctgaaccacattacgcccccagcggttctggaccaccttggctttcgtaggatgctcctttaacgcccgctgaccgttctcgctggtcacatccatttccaccacgtgctccttgcagaccatctccactccgtggaagcagaacaggacgccctcctgccgggtattgcgatgctcccatacggcgcatccggtgggctcccagctcttgcgtttcacccccgcgtatgcttccatgtaagccatgaggaatctgcccatcagctcggtgaaggtcttctggttggtgaaggtgagggacaggccgcgatgctcctcgttcaaccaagtttgacagatcttgcggtacacggctccctggtcgggcaaaaacttaaaagccgctcggctgtcgttgtccacgtggaacttctccattaacatcatcatggtttccatacccttctcccacgctgacaccagcggcttgctgtcggggttcttcaccaacacggcggtagaggggccctcgccggccccgacgtccttcatggacattctttgaaactccacggagccgtccgcgcggcgtactctgcgcataggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcgggactcatctcccgcaagtagggggtgatggagcttcctgcttggttctgacggttggccattgtatcctaggcagaaagacatggagcttatgcgcgaggaaactttaaccgccccgtcccccgtcagcgacgaagaggtcatcgtcgaacaggacccgggctacgttactccgcccgaggatctggaggggcccttagacgaccggcgcgacgctagtgagcggcaggaaaatgagaaagaggaggcggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcggctcaacttctaccccgtgttcgccgtgcccgaggcgctggccacctaccacatctttttcaaaaaccagcgcatccccctctcctgccgggccaaccgcaccgcggccgataggaagctcagacttaaaaacggagccgacatacctgatatcacgtcgctggaggaggtgcccaagatcttcgagggtctgggtcgagatgagaagcgggcggcgaacgctctgcagaaagaacagaaagagaatcagaacgtgctggtggagctggagggggacaacgcgcgtctggccgtcctcaaacgctgcatagaagtctcccacttcgcctaccccgccctcaacttgccgcccaaagttatgaaatcggtcatggatcagctgctcatcaagagagctgagcccctggatcccaaccaccctgaggcggaaaactcagaggacggaaagcccgtcgtcagcgacgaggagctcgagcggtggctggagaccagggacccccagcagttgcaagagaggcgcaagatgatgatggcggccgtgctggtcaccgtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggtgtgtggcagcagtgcttggaagagagaaacctcaaagagctggacaaactcctctaccgccagcggcgggccctctggaccggcttcagcgagcgcacggtcgcctgcgccctggcagacatcattttcccagaacgcctgatgaaaaccttgcagaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccacccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcatcgtcagcatgagcaaggagattcccaccccctacatgtggagctatcagccgcagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggctgaagtcctcatgactaactctggggtacaattagcgggcgggtccaggtacgccaggtacagaggtcggaccgctccttactctcccgggagtataaagagggtgatcattcgaggccgaggtatccagctcaacgacgaggcagtgagctcctcaaccggcctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaacgaactaattcagtggtttgctaacagttcactctgtaaagtatttcttaattctaaggtttttcctggattcggcagttcctcgtgtggaaacgttacccattcctccttaactgtctcagcgcctttttcagaaatccaatatttctgtattggagcaggaggtgaagcgggttgcgttcaccgttcgtttcttaaacgatttgttgctgttcctgttaacacctccctttcatctcattcttacttcatttacccccctgctcaccactcttggcaaccccttattggcctaacagctttcattaccatagttttacttaactttataatcattaacagactttcttaaaaaatgctgataattttgcttattactttcactcttgctgctgcttcccccaaatcaaatgatggttttatagacgtatatgctaaacaagggacaaacttacttatgcaatctcactatgcacctccagacgttattacacatattgcttggtacttagatgtttttcagggcattttcgacacaactataccttcatattttacgggggttaagctttgtgaaagctcaccacttcaagaacaggaatggtttcacccacctctacaatttcattgcataaacaatagcctacacttgtacaatctgaaacctagcgatgctggtgtttataatgctaaagttttttcagattccattgaacataatacatactttcaactacatgtgatttcttttccaaaacctaactgtaacattaactctacttacctaacaaacgactactgccttattaacatcgactgttccaaattatcatacccggccaaagtttattttaatggtaatcaaagtaaacttcattactatttatctgcacgcggaggcaacggaaaccttccagattattttactgttggctatgaatacagagacctcaaacaaaattatacagttcactatccattcaatgacctttgtgcagaaataaccgctcttgaaacggggtctgatttcacccctatctttatagttaccatagcggttagtgttatagttataattttagccattacatacttcatctaccactgtagaactttaaaaaaaaccaagaaaaacaagcctcctgaaatccgtttgctttaattttttccagaatggtagctgctttcttcattcttctctgtataccaatcatctgcgcctccacaacttttgctgctgtttcccacctggaaccagactgtctacaaccttttgttgtatacctaatactgacttttgtggtctgcacggccattaccagtatagcctgcttttttgtaacaattttccaagccgccgattacctctacgtacggtttgcttattttagacatcaccccgagtatcggaatcaaaacgtagcttctctgctttgtttagcatgattcgcatttttatactttgtaagctctttaccctcacaacatgtcattgtccttttaccaaaccctggtccttttacacttgttataatgtattgcccgaaacccctattgcctggctttacgtagccacagcggttttagtttttgcagcaacctgcattggagttaaactgtacttctacttaaagattggatggcttcatcccccagaagatttaccccgatatcctcttgttaataactttcaacagcctctgccgcctcctgatcctcttccgcgagctccctccgttgttagctactttcaactcaccggtggagatgactgactctcaagacattgatattaatgtggaaagaatagctgctcagcgtcagcgagaaacgcgggtgctggactaccttgaactacagcagcttaaagagtcccactggtgtgagaaaggagtgctgtgccatgttaagcaggcagccctttcttacgatgtcagcctccagggacatgaactatcttacactttgccttcgcaaaaacaaaccttctgcaccatgatgggccctacctccatcacaatcacccaacaaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatccagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccacgcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgttgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggcgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcagagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccaccaccaaagttcgcccacacccacaaaacccgcgaaaatccagcgccgtcagcacttccgcaatttcagtctcacaacgtcacttccgcgcgccttttccctttcccacacacgcccttcgcccgccccgccctcgcgccaccccgcgtcaccccgcgtcaccgcacgtcaccccggccccgcctcgctcctccccgctcattatcatattggcacgtttccagaataaggtatattattgatgatg

SEQ ID NO: 12 - DNA, 35252 bp, Rhesus Adenovirus 6669 (RhAd6669 / RhAd65) Wild Type
catcatcaataatataccttattctggaaacgtgccaatatgataatgagcggggaggagcgaggcggggccggggtgacgtgcggtgacgcggggtgacgcggggtggcgcgagggcggggcgggcgaagggcgtgtgtggggaggcgcttagtttttacgtatgcggaaggaggttttataccggaagttgggtaatttgggcgtatacttgtaagttttgtgtaatttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggttcccgagatgtacggtgttttctgcagcgagacggcccggaactcagatgagctgcttaatacagatctgctggatgttcccaactcgcctgtgacttcgcctccgtcgcttcatgatcttttcgatgtggaagtggatcctccgcaagatcccaacgaggacgcggtaaacagtatgttccctgaatgtctgtttgaggcggctgaggagggttctcacagcagtgaagagagcagacggggagaggaactggacttgaaatgctacgaggaatgtctgccttctagcgattctgaaacggaacagacagggggagactgctgtactgagccggtagcgaaaaatgaacttgtattagactgtcctgatcaacctggtcatggctgccgtgcctgtgcttttcatagaaatgccagcggaaatcctgaaactctatgtgctctgtgttacctgcgtcttaccagcaattttgtatacagtaagtaggagctttttcgatttgcgcatggtggtgggattgttaaagtgtgttgggcttattgtttgtgtaatgttttacaggtgacgtgtctgactcggaaggggacggagatagatcagggtctgctaattctccttgcactttgggggctgtggttccagctggcattattaaacccgtggcggtcagagtctcaggcagacggtgtgcagttgaaaaattggaagacttgctgcaggaagaacagaaggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcctatattttggatcaatggagcaacagcgacagccatctgtcgtgggagtacatgctggattacatggcgatggctttgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggcgctaggaaaaagcaaaaaactgagcctgaacctagaaactttttgaatgagttggctgtaagcctgatgaatcggcagcgtcctgagacggtgttttgggctgagttggaggatgagttcaagaagggggaattaaaccttttgtacaagtatgggtttgagcagttgaaaactcactggttggagccgtgggaggatatggaaatggctctagacacctttgctaaagtggctctgcggccggataaagtttatactattcgccgcactgttaatataaaaaagagtgtttatgttatcggccatggagctctggtgcaggtgcagaccccagaccgggtggctttcaattgcggcatgcagagtttgggccccggggtgataggtttgaatggagttacatttcaaaatgtcaggtttactggtgatgattttaatggctctgtgtttgtgactagcacccagctaacccttcacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactctcgccgcacctggccaacatttgagcacaatatgctcatgcgttgtgccgttcacctaggtgctagacgcggcgtgtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtaaggtgaggggcggagccacaaagggtataaaggggcatgaggggcgggcgcggtgtttcaaaatgagcggaacgacggacggcaacgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgaggccatctttggggtggagataggaccattgaagagcgtcatgctccggggtggtgttgtaaatcacccagtcgtagcagggtttctgggcgtggaactggaagatgtccttcaggagcaggctgatggccaggggtagacccttagtgtaggtgtttacaaagcggttgagctgggagggatgcatgcggggggagatgatatgcatcttggcttggattttgaggttagctatgttaccacccaggtccctgcgggggttcatgttatgaaggaccaccagcacggtgtagccggtgcatttggggaacttgtcatgcagtttggaggggaaggcgtggaagaatttggagacccccttgtgcccccctaggttttccatgcactcatccataatgatggcaatgggacccctggcggccgctttggcaaacacgttttggggattggaaacatcatagttttgctctagagtgagctcatcataggccatcttcacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagtttagagaggaacagctgccgtcggggcgcaggaggggggctacctcattcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttttgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggccccgcactgagcgcagacggtttcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtatccccgtacaccgacttgagggggcgatcttccaaaggcgttccgaggtcttccgcgtacaggaactgggaccactccgagacgaaggctctggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgatccgcaccccccaaaggggtataaaagggggcgtgcccaccctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaggggtccatctgatcagaaaacacgatctttttattgtcaagtctggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatctccccccttttctggagcagaacggaggcaggggatctagcaagttggcgggcggggggtcggcgtcgatggtgaagatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccattggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccacgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgagcggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggctgcagcaacgctaggtcggccacgaccctctcggccagcacggcctgttggatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtgaggaggcggttctcggtacaggggccagccaacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagagggggctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggttatcccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgcctcaccacggacgtgaaggaggcgctggctcagaaggagcggtttctgagggacagcaatctgggctctctggtggcactcaacgccttcctgagcacgcagccggccaacgtgccccgcgggcaggaggactacgtgagcttcattagcgctctgaggctgctggtgtccgaggtgccccagagcgaggtgtatcagtccggaccggattacttttttcagacgtcccgacagggcttgcaaacggtgaacctgactcaggcctttaaaaacttgcaaggtatgtggggcgtcaaggccccggtgggcgatcgcgccaccatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagattactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgggagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggctaatcgccgattccagaagaaggagggcggagacgagctccccctctccagcgtggaagcggcctcaaggggagagagtccctttcccagtctgtcttccgccagtagcggtcgggtcacgcgcccacggttgccgggggaaagcgactacctgaacgaccccttgctgcgaccggctagaaagaaaaatttccccaacaacggggtggaaagcttggtggataaaatgaatcgttggaagacctacgcccaggagcagcgggagtgggaggacagtcagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagcacggggtgctggagagcgatatcggcgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgcttgagtaacctgttaggaatcaggaagcgccgtcccttccaggagggctttcaaatcatgtatgaggatctggagggaggcaacattcccgccctactggacgtgtcaaagtatgaggacagcgtgaagaaggcggaagctcagggacgagaaattcggggcgacacatttgcggtggcaccccaagacctggtgatagagcctttgactaaagacagcaaaaacagaagctacaacattattaccggtactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctcgggccgaacggctgtagacgataccatagatgccgtgattgccgacgcccgacggtacaatcccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagagccgtgctgagacgggcccggagggtaggcagaagggctatgcgccgcgccgccgccaacgccgccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaattcgcctatggaaagcgctcgcgtcgcggagacttggccatcgctttagacagcggcaatcccacacccagcctcaaacccgtgacgctgcagcaggtgctccccgtgagcgccagcacggacagcaagaggggaataaaaagagaaatggaagatctgcagcccaccatccagctcatggtccctaaacggcagaggctggaagaggtcctggagaagatgaaagtggaccccagcatagagccggacgtcaaagtcaggccgatcaaagaagtggcccctggtctcggggtgcagacggtggatatccagatccccgtcacgtcagcttcgaccgccgtggaagccatggaaacgcaaacggaaacccctgccgcgatcggtaccagggaagtggcgttgcaaaccgacccctggtacgaatacgccgcccctcggcgtcagaggcggcccgctcgttacggccccgccaacgccatcatgccagaatatgcgctgcatccgtctatcctgcccacccccggctaccggggagtgacgtatcgcccgtcaggaacccgccgccgaacccgtcgccgccgccgctcccgtcgcgctctggcccccgtgtcggtgcggcgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataattgccgccgccatcggtgccatacccggcgtcgcttcagtggccttgcaagcagctcgtaataaataaacgaaggctttttgcacttatgacctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaacggggtggtgaccggcatccacggcgcggtagatctcgccaaccaagcggtgcagaaagagattgacaggcgtttggaaaactcgcgggtgccgccgcagaggggggatgaggtggaggtcgaggaagtagaagtagaggaaaagctgccccccctggagaaagttcccggtgcgcctccgagaccgcagaagcggcccaggccagaactagaagagactctggtgacggagagcaaggagcctccctcgtacgagcaagccttgaaagagggcgcctctccaccctcctacccgatgactaagccgatcgcacccatggctcgaccggtgtacgggaaggactacaagcctgtcacgctagagctccccccgccgccaccaccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagtgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggatcgctcgcagaggctgaccctgcgcttcgtgcccgtagaccgggaggacaccgcgtactcttacaaagtgcgctacacgctggccgtaggggacaaccgggtgctcgacatggccagcacctactttgacatccggggggtgctcgatcgcggtcccagcttcaagccctattcggggaccgcctacaactccctggctcccaagggcgcccccaaccccgctgaatgggcagattctgacagcaaactgaaagtgagggcacaggcaccttttgtcagctcctacggtaataatgcgattacaaaggaaggtattcaggtaggagtaattttaacagactccggacaaacagcacaatatgcggacaaaacgtatcagcctgagccgcagattggagaactacagtggaacagcgaagtaggaaccaatgataaagtagcgggaagggtgcttaagaagacgactccaatgtttccctgttatggttcatacgccaagcctaccaatgcaaaaggagggcaggcgacacagcctgctagtcaagaaactcaaaatccagaattgcagttttttgctgcttccagcaccgtcaacactccaaaagcagtattatacgcagaggacgtgtctattgaagctccagacactcacctggtatttaaaccatcagtaactgaaggaactacaagttcggaagctctactggcacaacaagctgcccctaacaggccaaactatattgcctttcgggacaattttattggcctaatgtattacaatagcactggaaacatgggagtgctggccggacaggcgtcgcaactcaatgcggtggtcgatttgcaagacagaaacacagaactgtcataccagctaatgcttgacgctctgggagatagaagtcgctacttctctatgtggaatcaagccgtggacagttacgatccagatgttagaatagtggaaaatcacggcgtcgaagatgaattgcctaattactgcttccctttgggcggtatggcagtgactgacacctactcgcctataaagcttaatggtgggcaaaacggatgggaagctaataatgacgtttatgccgaaagaggagtggaaataggctcagggaacctgttcgctatggagatcaacctgcaggccaacctgtggcgcagtttcttgtattccaacatcgggctgtacctcccggacactctcaaaatcactcccgacaacatcacgctgccggagaacaagaacacctaccagtacatgaacggtcgcgtgactccccccgggctcgtggacacctacgtcaacgtgggtgcgcgctggtcccccgatgtcatggacagcatcaaccccttcaaccaccaccgcaacgcggggctgcggtaccgttccatgctgctgggcaacggtcgctacgtgcccttccacatccaagtgccccagaaattctttgccatcaagaacctgctgctgctgcccgggtcctacacctacgagtggaacttccgcaaggacgtcaacatgatcctgcagagttccctcggcaacgacctgcgggtggacggggccagcatccgcttcgacagcattaacctctacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggtttgacccctacttcgtctactccggctccatcccctacctggacggcaccttctacctcaaccatactttcaaaaaggtgtcaatcatgttcgactcctcggtcagctggcccggcaacgaccgtctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcaacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctgacgcagaagaagttcctctgcgaccgggtgatgtggaggatccccttctctagcaacttcatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggagacagggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttatttgacatgatacgcgcttctggcgtttttattaaaaatcgaagggttcgagggaggggtcctcgtgcccactggggagggacacgttgcgatactggaaacgggcgctccaacgaaactcggggatcaccagccgcggcaggggcacgtcttctaggttctgcttccaaaactgccgcaccagctgcagggctcccatgacgtcgggcgccgagatcttgaagtcgcagttagggccggagctcccgcggctgttgcggaacacggggttggcacactggaacaccagcacgccggggttgtggatactggccagggccgtcgggtcggtcacctccgacgcatccagatcctcggcgttgctcagggcaaacggggtcagcttgcacatctgccgcccgatctggggtactaggtcgcgcttgttgaggcagtcgcagcgcagagggatcaggatgcgtcgctgcccgcgttgcatgatagggtaactcgccgccaggaactcctccatttgacggaaggccgtttgggctttggcgccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgaccgttctcgctggttacatccatttccaacacgtgctccttgcagaccatctccactccgtggaagcagaacaggacgccctcctgctgggtactgcgatgctcccatacggcacatccggtgggctcccagctcttgtgttttacccccgcgtaggcttccatgtaagccatgaggaatctgcccatcagctcggtaaaggtcttctgattggtgaaggtcagcggcaggccgcggtgctcctcgttcaaccaagtttgacagatcttgcggtacacgactccctggtcgggcagaaacttaaaagcccctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttgaaactccacggagccgtccgcgcgacgtactctgcgcaccggagggtagctgaagcccacctccaccacggtgccttcgccctcgctgtcggagacaatctccggggatggcggcggcggcgcgggtgttgccttgcgagccttcttcttgggagggagcggaggcacctcctgctcgcgctcggggctcatctcccgcaagtagggggtgatggagctgcctgcttggttctgacggttggccattgtatcctaggcagaaagacatggagcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggctttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtaccagaggcgctggccacctatcacatttttttcaaaaaccaacgcatccccctctcgtgccgggccaaccgcaccgcggccgataggaatctcaggcttaaaaacggagccgacatacctgatatcacgtccttggaggaggtgcccaagattttcgaaggtctgggtcgagatgagaagcgggcggcgaacgctctgcagaaagaacacaaagaaagtcagaacgtgctggtggagctggagggggacaacgcgcgtctggccgtcctcaagcgctgcatagaagtttcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggagggactacgtccgagactgcgtctacctcttcctcaccctcacctggcagaccgccatgggcgtgtggcagcagtgcttggaagagagaaacctcaaagagctggacaaactcctctgccgccagcggcgggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctcttttgtcctggagcgctccgggatcttgcccgccatgagctgcgcgctaccttctgactttgtccccctctcctaccgcgagtgccctccccccctgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtacccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacatccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgtcagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaagcgatcgtcttcagctactttgagctgccggacgagcaccctcagggaccggctcacgggttgaaactcgagatcgagaacgcgctcgagtctcacctcatcgacgccttcaccgcccgacctctcctggtggaaaccgaacgcgggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctccctatagaggtatcatacaaactgtttactttgacaactctactactctcctaaccctcaactgctcttgctctaacgaactaactcagtggattgcaaacggcaccatctgcataacttttcttaattctgaagtttttcaccaacgcaacaactctctgtgcggtaatactactctgcacaccttaaccctcacaccaccttttgcggaacttcaatacttttgcatcggggtaggaaagggaccgagttgctggcaccgttcttttttaaaaaaagctgttccgcctacaattagctctgcttccgctcctaacaattccacttctttaaatttcactctctcagcctatttaacaactcacacttcttggcaacctgttgttactttaacagctcttatcttgttagtgctgtttaactttgttttaattgaatacctagtatcactatgaacaagataattactgcagccttcattattctatgtgtctcctccatcttatgcagcacggaagacgctgaagttgtttatgttaaaataggatctaacaaatctcttgaatcaacctttttacctgatccccccgcaataccgcatattatttggtacaaagaggtttttgattccatttttggcccgcaaaccccctcatattatttttcaggggttaaatattgtgagatttctgaatctaaaaaccaaatctgggatcattatccggcagaatttaattgcataaaccaaagcctcaattttttcaacttaaaaccttcagattctggcctgtaccaagctcaggttattaacaacagtataatatacagtaattacatctatctgtatgttatagatcttccagctccacagtgcgttgtcagttcttattacctcgaagtacaacataagccaagtacatattgcctcatagaaattaactgctcaaaatcagaatatcctgctgaagtcttttttaatggcaaacgaagcaatttacatcactatgtcacagatactgggaacaaacctttgccaaattatttcactaccactattaaagcttatggattaacacaaacttacaaccattcttatgaatttaacgacctttgtaatgatataattgctcttgaaacaggtgctgatttcacgccaattttcatagttaccatagtggtgagcgtgatagtcattattctaggcattacgtacctcatttaccactgtagaactttaaaaacccataaaaaaaccaagcctcctgaaatccgcttactttaatgttttccagaatggtagctgccttcttcattcttctctgtataccaatcatctgcgcctccacaacttttgccgctgtttcccacctggaaccagactgtctaccaccttttgttgtatacctaatactgacttttgtggtctgcacggccattaccagtatagcctgcttttttgtaacaattttccaagccgccgattacctctacgtacggtttgcttattttagacatcaccccgagtatcggaatcaaaacgtagcttctctgctttgtttagcatgattcgcatttttatactttgtaagctctttaccctcacaacatgtcattgtccttttaccaaaccctggtccttttacacttgttataatgtattgcccgaaacccctattgcctggctttacgtagccacagcggttttagtttttgcagcaacctgcattggagttaaactgtacttctacttaaagattggatggcttcatcccccagaagatttaccccgatatcctcttgttaataactttcaacagcctctgccgcctcctgatcctcttccgcgagctccctccgttgttagctactttcaactcaccggtggagatgactgactctcaagacattgatattaatgtggaaagaatagctgctcagcgtcagcgagaaacgcgggtgctggactaccttgaactacagcagcttaaagagtcccactggtgtgagaaaggagtgctgtgccatgttaagcaggcagccctttcttacgatgtcagcctccagggacatgaactatcttacactttgccttcgcaaaaacaaaccttctgcaccatgatgggccctacctccatcacaatcacccaacaaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatcgagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgaaccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgttgtgagtcagtccggtatttgggagttaaaatccaaacagtctctttggtgatgagacatcgatccgtgatggacacaaatccctgggacaggttctccaacgtttcggtgaaaaactgcgcgccgccctacaaaacaaacaggttcaggctctccacgggttatctccccgatcaaactcagacaaggtaaaggtgcgatgatgttccactaaaccacgcaggtggcgctgtctgaacctctcggtgcgactcctgtgaggctgataggaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgcccgtccaaccttactttaacataaatcaggtgtctgccgcgtacaaacatactacccgcatacagaacttcccggggcaaacccctgttcaccacctgcctgtaccagggaaacctcacatttatcagggaaccatagatagccattttaaaccaattagctaacaccgccccaccagctctacactgaagagaaccgggagagttacaatgacagtgaataatccatctctcataacccctgatagtctgatggaaatccagatctaacgtggcacaacagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccgacgcacttcctcgtacttgtagtagcagaaccacgtccgccgccagcacgtctccaagtaacgccggtccctgcgtcgctcacgctccctcctcaacgcaaagtgcaaccactcttgtaatccgcacagatccctctcggcctccggggcgatgcacacctcaaacctacagatgtctcggtacagttccaaacacgtagtgagggcgagttccaaccaagacagacagcctgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcagagacagcaaaacaatccctctgggagcaatcacaaaatcctccggtgaaaaaagcacacacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccaccaccaaagttcgcccacacccacaaaacccgcgaaaatccagcgccgtcagcacttccgcaatttcagtctcacaacgtcacttccgcgcgccttttttcgctattcccacacccgccccgccctcgcgccaccccgcgtcaccccgcgtcaccgcacgtcaccccggccccgcctcgctcctccccgctcattatcatattggcacgtttccagaataaggtatattattgatgatg

SEQ ID NO: 13 - DNA, 35158 bp, Rhesus Adenovirus 6672 (RhAd6672 / RhAd66) Wild Type
catcatcaataatataccttattttggaaacgtgccaatatgataatgagcgaggcggggccggggtgacgcgagggtgacgcggggtggcgcgagggcgaggcgggtgtggggaggcgcttagtttttacgtatgcggaaggaggttttataccggaagttgggtaatttgggcgtttacttgtaagttttgtgtaatttggcgcgaaaaccgggtaatgaggaagtagaggttaatatgtactttttatgactgggcggaatttctgctgatcagcagtgaactttggccgctgacggggaggtttcgctacgtggcagtaccacgagaaggctcaaaggtcccatttattgtactcctcagcgttttcgctgggtatttaaacgctgtcagatcatcaagagaccactcttgagtgccggcgagtagagttttctcctccgcgctgccgcgatgaggctggttcccgagatgtacggtgttttctgcagcgagacggcccggaactcagatgagctgcttaatacagatctgctggatgttcccaactcgcctgtgactttgcctccgtcgcttcatgatcttttcgatgtggaagtggatccaccgcaagatcccaacgaggacgcggtaaacagtatgttccctgaatgtctgtttgaggcggctgaggagggttctcacagcagtgaagagagcagacggggagaggaactggacttgaaatgctacgaggaatgtctgccttctagcgattctgaaacggaacagacagggggagactgctgtactgagccggtagtgaaaaatgaacttgtattagactgtcctgatcaacctggtcatggctgccgtgcctgtgcttttcatagaaatgccagcggaaatcctgaaactctatgtgctctgtgttacctgcgtcttaccagcgattttgtatacagtaagtaggagctttttcgatttgcgcatggtggtgggattgttaaagtgtgttgggcttattgtttgtgtaaatgttttacaggtgacgtgtctgacacggaaggggacggagatagatcagggtctgctaattctccttgcactttgggggctgtggttccagatggcattattaaacccgtggcggtcagagtctcaggcagacgatgtgcagttgaaaaattggaagacttgctgcaggaagaacagaaggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcctatattttggatcaatggagcaacagcgacagccacctgtcgtgggagtacatgctggattacatggcgatggctttgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggcgctaggaaaaagcaaaaaactgagcctgaacctagaaactttttgaatgagttggctgtaagcctgatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttatactattcgccgcactgttaatataaaaaagagtgtttatgttatcggccatggagctctggtgcaggtgcagaccccagaccgggtggctttcaattgcggcatgcagagtttgggccccggggtgataggtttgaatggagttacatttcaaaatgtcaggtttactggtgatgattttaatggctctgtgtttgtgactagcacccagctaacccttcacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgtgccgttcacctaggtgctagacgcggcgtgtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctacgtaccgactatgaatccagcgatgaggagtgaggtgaggggcggagccacaaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtggcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgagaccatctttggggtggagataggaccactgaagagcgtcatgctccggggtggtgttgtaaatcacccagtcgtagcagggtttctgggcgtggaactggaagatgtccttcaggagcaggctaatggccaggggtagacccttagtgtaggtgtttacaaagcggttgagctgggagggatgcatgcggggggagatgatatgcatcttggcttggattttaaggttagctatgttaccacccaggtccctgcgggggttcatgttatgaaggaccaccagcacggtgtagccggtgcatttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtttgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccaaaggggtataaaagggggcgtgcccaccctccccgtcactttcttccgcatcgctgtggaccagagccagctgttcgggtgagtaggccctctcaaaagccggcatgatttcggcgctcaagttgtcagtttctacaaacgaggtggatttgatattcacgtgccccgcagcgatgcttttgatggtggaggggtccatctgatcagaaaacacgatctttttattgtcaagtttggtggcgaaagacccgtagagggcgttggaaagcaacttggcgatggagcgcagggtctgatttttttcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcggacggggggtcggcgtcgatggtgaagatgccgggtagcagaattttattaaaataatcgatttcggtgtccgtgttttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgcggggtttctcggcccggtagaggatctgcctgaagatggcgtgggagttggaagagatggtggggcgttggaaaacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcatcgaagccgttgatgttgtggcccacgatgtaaagttcgataaagcgcggctgtcccttgagggccggcgcttttttcaactcctcgtaggtgagacagtccggcgaggacagacccagctcagcccgggcccagtcggagagttgaggattagccgcgaggaaggaactccatagatccaaggccaggagagtttgcaagcggtcgcggaactcgcggaactttttgcccacggccattttctccggcgttaccacgtaaaaggtgtcggggcggttgttccagacgtcccatcggagctctagggccagctcgcaggcttggcgaacgagggtctcctcgcccgagacgtgcatgaccagcatgaagggtaccaactgtttcccaaacgagcccatccatgtgtaggtttctacgtcgtaggtgacaaagagccgctgggcgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagactggggcttggtggggcggcatccccttcgccttggcggtgggagtctgcgtctgcgcccttcttctctgggtggacgacggtggggaagacgacgccccgggtgccgcaagtccagatctccgccacggaggggcgcaggcgctgcaggagggggcgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtcagcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgtcgcagggtcatctcgttgatgtctccgatggcttcgagacgctccatggcctcgtagaagtcgacggcgaagttgaaaaattgggagttgcgggcggctaccgtgagttcttcttgcaggaggcggatgagatcggcgaccgtgtcgcgtacctcctgttcgaaagcgccccgaggcgcctctacttcttcctccggctcctcctcttccaggggcacaggttcctccgccagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaaaacgccgccgcgcagagcgcccccgtgcagggagggtaagtggttagggccgtcgggcagggacacggcgctgacgatgcattttatcaattgctgcgtaggcactccgtacagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgttcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggccctggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcaggggacggaagcgttccatggtgggcacgctctgccccgtgaggcgggcgcagtcctgtacgctctagatggaaaaaagacagggcggtcatcgactcccttccgtagctcggggggtaaagtcgcaagggtgcggcggcggggaaccccggttcgaaaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgaccccagacgcccaccaccaccgccgcggcggcagtaaacctgagcggaggcggtgacagggaggaggaggagctggctttagacctggaagagggagaggggctggcccgactgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgaaacgttccgcgacgccatgttgaacatcgcggagcccgagggtcgctggctcttggatctgattaacatcttgcagagcatcgtggtgcaggagagggggctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaagtgctgacgctgagcgacgacctcggcgtgtaccgtaacgacaagatccacaaggcggtgagcgccagccgccggcgggagctgagcgacagagagctgatgcacagcctgcagagggcgctggcgggcgccggggacgaggagcgcgaggcttacttcgacatgggagccgatctgcagtggcgtcccagcgcgcgcgccttgaaggcggcgggctaccccgacgaggaggatcgggacgatttggaggaggcaggcgagtacgaggacgaagcctgaccgggcaggtgttgttttagatgcagcggccggcggacggggccaccgcggatcccgcaattttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtaccgtcgcgcaccaacccgacgcacgagaaagtcctgactatcgtaaacgccctggtagacagcaaggctatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggttctctggtggcactgaacgcctttctgagcacgcagccggccaacgtgccccgcgggcaggaggattacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaatttgcaaggcatgtggggcgtcaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgtgtccgacagcattttcacgccggctaatcgccgattccagaagaaggagggcggagacgagctccccctctccagcgtggaagcggcctcaaggggagagagtccctttcccagtctgtcttctgccagtagcggtcgggtaacgcgcccgcggttgccgggggagagcgactacctgaacgaccccttgctgcgaccggctagaaagaaaaatttccccaacaacggggtggaaagcttggtggataaaatgaatcgttggaagacctacgcccaggagcagagggagtgggaggacagtcagccgcgaccgctggttccgccgcactggcgtcgccagagagaagacccggacgactccgcagacgatagtagcgtgttggacctgggagggagcggagccaacccctttgctcacttgcaacccaaagggcgttcgagtcgcctgtactaataaaaaagacgcggaaacttaccagagccatggccacagcgtgtgtcctttcttcctctctttcctcctcggcgcggcagaatgagaagagcggtgagagtcacgccggcggcgtatgagggcccgcccccttcttacgaaagcgtgatgggatcagcgaacgtaccggccacgctggaggcgccttacgttcctcccagatacctgggacctaccgagggcagaaacagcatccgttactccgagctcgcgcccctgtacgataccaccaaggtgtacctggtggacaacaagtcggcggacatcgcctccctgaattaccaaaacgaccacagcaacttcctgactaccgtggtgcagaacaatgacttcaccccgacggaggcgggcacgcagaccattaattttgacgagcgttcccgctggggcggtcagctgaaaaccatcctgcacaccaacatgcccaacatcaacgagttcatgtccaccaacaagttcagggctaagctgatggtagaaaaaattagcggacaacctcccaaatatgaatggttcgagttcaccattcccgagggtaactactccgagaccatgactatcgatctgatgaataacgcgattgtggacaattacctgcaagtggggaggcagaacggggtattggaaagcgatatcggtgtgaaatttgataccagaaacttccgactggggtgggatcccgtgaccaagctggtgatgccaggcgtgtacaccaatgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcggcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaagaggcgctccagtcagcacccagttcgagttcggggccacttccgcgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggagagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgtcacgtcagcttcaaccgccgtggaagccatggaaacgcaaaccgaaacccccgccgcggttggtacgaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacaattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgcgggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgcggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggtacaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaacgcagttgtggacttgcaagacagaaacaccgaattgtcataccagcttatgctcgacgcattgggagacagaagtcgatacttttcaatgtggaatcaagctgtcgacagttacgatccagatgttaggataattgaaaaccacggcgttgaagacgagcttccaaattattgttttccactaaatggacagggaatttcaaacacctacaaggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggccggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctccgcaacgacaccaacgaccagtccttcaacgactacctgtgcgcagctaacatgctgtaccccatccccgcgaacgccaccagcgtgcccatctctattccctctcgcaactgggcagcctttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggccaggcaacgaccgcctgctaacgcccaacgagttcgaaattaagcgttcggtagacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctaatcggggccaccgccgtacccagcctgacgcagaaaaagttcctctgtgaccgggtgatgtggaggatccccttctctagcaactttatgtctatgggctccctcaccgacctggggcagaacatgctgtacgccaactccgctcacgccttggacatgacatttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtctcccccaccctgcgccgtaaccaggaacacctgtatcgctttttggggaaacactctgcctactttcgccgccaccggcagcgcattgaacaggccacggcctttgaaagcatgaaccaaagagtgtaatcaataaaaaccatttttattttaacatgacacgcgcttctggcgttttttattaaaaatcgaagggttcgagggaggtgtcttcgtgcccgctggggagggacacgttgcggtactggaaacgggcgctccaacgaaactcggggatcaccagtcgcggcaggggcacgtcttccaggttctgcttccagaactgccgcaccagctgcagagctcccatcacgtcgggcgccgagatcttgaagtcgcagttagggccggagctcccgcggctgttgcggaacacggggttggcgcactggaacaccagcacgctggggttgtagatactagccagggccgtcgggtcggtcacctccgacgcatccagatcttcggcgttgctcagggcgaacggggtcagcttgcacatctgccgcccgatctggggcaccaggtcggatttgttgaggcaatcgcagcgcagagggatgaggatgcgacgctgcccgcgttgcatgatagggtaactcgctgccaggaactcctccatctgacggaaggccatctgggccttcgtgccctcggtgaaaaagagcccacaggacttgctagagaatacgttattgccgcagttgatgtcttccgagcagcagcgggcgtcttcattcttcagctgaaccacgttgcgaccccagcggttctggaccaccttggctttcgtaggatgctccttcaacgcccgctgaccgttctcgctggtcacatccatttccaccacgtgctccttgcagaccatctccactccgtggaagcagaacaggacgccctcctgccgggtattgcgatgctcccacacagcgcacccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccaaggtgccttcgccctcgctgtcggaaacgatctccggggagggcggcggcgcgggtgttgccttgcgagccttcttcttgggagggagcggaggcacctcctgctcgcgctcggggctcatctcccgcaagtagggggtgatggagcttcctgcttggttctgacggttggccattgtatcctaggcagaaagacatggagcttatgcgcgaggaaactttaaccgccccgtcccccgtcagcgacgaagatgtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatagttaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcgactcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcaaacgctctgcagaaagaacagaaagaaagtcagaacgtgctggtggagctggaaggggacaacgcgcgtctggccgtcctcaaacgttgcgtagaagtttcccacttcgcctaccccgccctcaacctgccgcccaaagttatgaaatcggtcatggaccagctactcatcaagagagctgagcccctggatcccgaccaccctgaggcggaaaactcagaggacggaaagcccgttgtcagcgacgaggagctcgagcggtggctggaaaccagggatccccagcagttgcaagagaggcgcaagatgatgatggcggccgtgctggtcacggtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggcgtgtggcagcagtgcttggaagagagaaacctcaaagagctggacaaactcctctgccgccagcggcgggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctcttttgtcctggagcgctccgggatcttgcccgccatgagctgcgcgctgccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaaaatcctggcccaattgcaatccatcaaccaagcgcgccgagatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttctccctcgggcgccaaaacccacgtcatcgccagcatgagcaaggagattcccaccccttacatgtggagctatcaaccccagatgggcctggccgcgggggccgcccaggactactccagcaaaatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaacgaactaattcagtggtttgctaacagttcactctgtaaagtatttcttaattctaaggtttttcctggattcggcagttcctcgtgtggaaacgttacccattcctccttaactgtctcagcgcctttttcagaaatccaatatttctgtattggggcaggaggtgaagcgggttgcgttcaccgttcgtttcttaaacgatttgttgctgttcctgttaacacctccctttcatctcattcttacttcatttacccccctgctcaccactcttggcaaccccttattggcctaacagctttcattaccatagttttacttaactttataatcattaacagactttcttaaaaatgctgataattttgcttattactttcactcttgctgctgcttcccccaaatcaaatgatggttttatagacgtatatgctaaacaagggacaaacttacttatgcaatctcactatgcacctccagacgttattacacatattgcttggtacttagatgtttttcagggcattttcgacacaactataccttcatattttacgggggttaagctttgtgaaagctcaccacttcaagaacaggaatggtttcacccacctctacaatttcattgcataaacaatagcctacacttgtacaatctgaaacctagcgatgctggtgtttataatgctaaagttttttcagattccattgaacataatacatactttcaactacatgtgatttcttttccaaaacctaactgtaacattaactctacttacctaacaaacgactactgccttattaacatcgactgttccaaattatcatacccggccaaagtttattttaatggtaatcaaagtaaacttcattactatttatctgcacgcggaggcaacggaaaccttccagattattttactgttggctatgaatacaaagacctcaaacaaaattatacagttcactatccattcaataacctttgtgcagaaataaccgctcttgaaacggggtctgatttcacccctatctttatagttaccatagcggttagtgttatagttataattttagccattacatacttcatctaccactgtagaactttaaaaaaaaccaagaaaaacaagcctcctgaaatccgtttgctttaattttttccagaatggtagctgctttcttcattcttctctgtataccaatcatctgcgcctccacaacttttgctgctgtttcccacctggaaccagactgtctacaaccttttgttgtatacctaatactgacttttgtggtctgcacggccattaccagtatagcctgcttttttgtaacaattttccaagccgccgattacctctacgtacggtttgcttattttagacatcaccccgagtatcggaatcaaaacgtagcttctctgctttgtttagcatgattcgcatttttatactttgtaagctctttaccctcacaacatgtcattgtccttttaccaaaccctggtccttttacacttgttataatgtattgcccgaaacccctattgcctggctttacgtagccacagcggttttagtttttgtagcaacctgcattggagttaaactgtacttctacttaaagattggatggcttcatcccccagaagatttaccccgatatcctcttgttaataactttcaacagcctctgccgcctcctgatcctcttccgcgagctccctccgttgttagctactttcaactcaccggtggagatgactgactctcaagacattgatattaatgtggaaagaatagctgctcagcgtcagcgagaaacgcgggtgctggactaccttgaactacagcagcttaaagagtcccactggtgtgagaaaggagtgctgtgccatgttaagcaggcagccctttcttacgatgtcagcctccagggacatgaactatcttacactttgccttcgcaaaaacaaaccttctgcaccatgatgggccctacctccatcacaatcacccaacaaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcggccgcaaacccactccttcttcaaaataacacactgagtcttatttccagtgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacataaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatctatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggcgccctgcttaacatgactcaaacctctgtaacaatccagttcacatttgataatactggttcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccaattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggtaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttgacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaagggaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgatgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggtgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcagcagtgggtcgaaatgaagatcccgaagatgacaacggtcgcctccggaaccctggtggaatttaacagccagatcaaacattatacgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcgctaaaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacaacaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcaaagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacaaaaaatcgagctaaaatccacccaacagcctatagctatatatacactccgcccaatgacgctaataccgcaccacccaccaccaaagttcacccacacccacaaaacccgcgaaaatccagcgccgtcagcacttccgcaatttcagtctcacaacgtcacttccgcgcgccttttcccattcccacacacacaaacgccgccctcgcgccaccccgcgtcaccctcgcgtcaccccggccccgcctcgctcattatcatattggcacgtttccaaaataaggtatattattgatgatg

SEQ ID NO: 14 - DNA, 35125 bp, Rhesus Adenovirus 6673 (RhAd6673 / RhAd67) Wild Type
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggtccccgagatgtacggtgttttctgcagcgagacggtccggaactcagatgagctgcttaatacagatctgctggatgttcccaactcgcctgtggcttcgcctccgtcgcttcatgatcttttcgatgtggaagtggatccaccgcaagatcccaacgaggacgcggtaaacagtatgttccctgaatgtctgtttgaggcggctgaggagggttctcacagcagtgaagagagcagacggggagaggaactggacttgaaatgctacgaggaatgtctgccttctagcgattctgaaacggaacagacagggggagactgctgtactgagccggtagtgaaaaatgaacttgtattagactgacctgatcaacctggtcatggctgccgtgcctgtgcttttcatagaaatgccagcggaaatcctgaaactttatgtgctctgtgttacctgcgtcttaccagcgattttgtatacagtaagtaggagctttttcgatttgcgcatggtggtgggattgttaaagtgtgttgggcttattgtttgtgtaatgttttacaggtgacgtgtctgacacggaaggggacggagatagatcagggtctgctaattctccttgcactttgggggctgtggttccagttggcattattaaacccgtggcggtcagagtctcaggcagacggtatgcagttgaaaaattggaagacttgctgcaggaagaacagacggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcctatattttggatcaatggagcaacagcaacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttatcggccatggagctctggtgcaggtgcagaccccagaccgggtggctttcaattgcggtatgcagagtttgggccccggggtgataggtttgaatggagttacatttcaaaatgtcaggtttactggtgatgattttaatggctctgtgtttgtgactagcacccagctaaccctccacggtgtttacttttttaactttaacaatacatgtgtggagtcatggggtagggtgtctctgaggggctgcagttttcatggttgctggaaggcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgtgccgttcacctaggcgctagacgcggcgtgtttatgccttatcaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggtcgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggaggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgtctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccataacggaccagttgacgacttgcatgccgggttgggtaatctccgtgtacttgaggcgcgagtaggcgcgggactcgaacacgtagtcgttgcatgtgcgtaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggctgcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgcctcaccacggacgtgaaggaggcgctggctcagaaggagcgctttctgagggacagcaatctgggttctctggtggcactcaacgccttcctgagcacgcagccggccaacgtgccccgcgggcaggaggactacgtgagcttcattagcgctctgaggctgctggtgtccgaggtgccccagagcgaggtgtatcagtccggaccggattacttttttcagacgtcccgccagggcttgcaaacggtgaacctgactcaggcctttaaaaacttgcaaggtatgtggggcgtcaaggccccggtgggcgatcgcgccaccatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagtcgggctctgggtcaggaagacaccggcagcttggaagccacgttgaactttttgctgaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcctcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaacccaacagccccgatacgagtggtttgagtttactattccagagggcaactactccgagaccatgactatcgatctaatgaataacgcgatcgtggacaattacctgcaagtggggaggcagaacggggtattggaaagcgatatcggtgtgaaatttgataccagaaacttccgactggggtgggatcccgtgaccaagctggtgatgccaggcgtgtacaccaacgaggcttttcaccccgacatcgtgctgcttccggggtgtggtgtggactttactcagagccgcttgagtaacctgttaggaatcaggaagcgccgtcccttccaggagggctttcaaatcatgtatgaggacctggagggaggtaacattccaggcttgctagacgtgccggcgtatgaacaaagcttacagcaagcccaagaggaggggcgagtaactcgcggagacacctttgctacggctccccatgagttggtgattcagcctttaacgaaagacagtaaaaacagaagttacaaccttatacccaactctacggatacactgtaccggagctggttcctggcttacaactacggcgatcccgagaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtccaccgcgcttacccacgtgttcaatcgctttcccgagaaccagattttggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctcgggccgaacggcggtagacgataccatagatgccgtgattgccgacgcccgccggtacaatcccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgcctccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcggcgcagggtgcagtggaaagggcggcgggtacaacgcgttttgaggccgggcaccgcggtagtttttaccccaggacagcggtcggccgtcaggggtttcaaacggcagtacgacgaggtgtacggcgacgaggacatactggaacaggcggctcaacagatcggagaattcgcctacgggaagcgttctcgccgcgaagacttggccatcgccttagacagcggcaaccccactcccagtctcaaacccgtgacgctgcagcaggtgctccccgtgagcgccagcacggacagcaagaggggaataaaaagagaaatggaagatctgcagcccaccatccagctcatggtccctaaacggcagaggctggaagaggtcctggagaagatgaaagtggaccccagcatagagccggacgtcaaagtcaggccgattaaagaagtggcccctggactcggggtgcagacggtggacatccagatccccgtcacgtcagcttcgaccgccgtggaagccatggaaacgcaaacggaaacccctgtcgcgatcggtaccagagaagtgtcgttgcaaaccgacccctggtacgaatttgccgccccccggcgtcagaggcgacccgctcgttacggccccgccaacgccatcatgccagaatatgcgctgcatccgtctatcctgcccacccccggctaccggggagtgacgtatcgcccgtcaggaacccgccgccgaacccgtcgccgccgccgctcccgtcgcgctctggcccccgtgtcggtgcgccgcgtaacccgccggggaaagacagtagtcatccccaacccgcgttaccaccctagcatcctttaatgactctgccgttttgcagatggctctgacttgccgcgtgcgccttcccgttctacactatcgaggaagatctcgtcgtaggagaggcatggcgggcagtggtcgccgacgggctttgcgcaggcgcatgaaaggcggaattttacccgccctgatacccataatcgccgccgccatcggtgccatacccggcgttgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaatggggtggtgaccggcattcacggcgcggtagatctcgccaaccaagcggtgcagaaagagattgacaggcgtttggaaaactcgcgggtgccgccgcagagaggggatgaggtggaggtcgaggaagtagaagtagaggaaaagctgcccccgctggaaaaagttcccggtgcgcctccgagaccgcagaagcggcccaggccagaactagaagagactctggtgacggagagcaaggaacctccctcgtacgagcaagccttgaaagagggcgcctctccaccctcctacccgatgactaagccgatcgcacccatggctcgaccggtgtacgggaaggactacaagcctgtcacgctagagctccccccgccaccaccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggggtgaaaagcctgaaacgccgccgttgctattattaaaagtgtagctaaaaaatttcccgttgtatacgcctcctatgttaccgccagagacgcgtgactgtcgccgcgagtgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagctttaagccctactccggaaccgcttacaactccctggctcccaagggtgctcccaaccctgcagaatgggaaaattctgacaacaagctaaaagtgagggctcaggcgccttttgttagctcttacggtgccactgcaattacaaaggatggtattcaagttggagtagtattaacagactcgacacagacgccacagtatgcggataaaacgtatcagcctgagccgcaaattggggaactacagtggaacagcgaagtgggaaacgatgataaagtagcaggcagggttctaaagaaaacaacacctatgtttccttgttacggttcatatgccaagcctaccaacgacaaaggagggcaggcaacacagcccgctgctggtcaagacgctcagaatgcagtagaattacagttctttgctactactagcgccaccaccactccaaaagcggtgttatacgctgaggatgtgtccattgaaacaccagacacccaccttgtgttcaagccaacagtaactgcgggaactacaagttcagaagctttgctgtcccaacaagccgctcccaaccgaccaaactacattgccttcagagataactttatcggccttatgtactacaacagcacgggaaacatgggagtactggccggtcaggcatcccagttaaatgccgtggttgatttgcaagacagaaatactgaactgtcatatcagctaatgttggacgcgctgggagaccgcagtcgctacttctctatgtggaaccaagctgttgacagttacgatccagatgtgagaatagtggaaaatcacggcgtagaagatgaattgccaaattattgctttccattgggcggaacggtagttacggatacctacacgcccatacagccaaatagcaatggaggaggcacatgggttgcaaaagataacgtttttacagatagaggagtggaaataagctcaggtaatatgtttgccatggaaattaacctacaagccaacctctggcgcagctttttgtattccaatattggattgtacctcccagacaccctgaaaataacccccgacaacattacgctgccagagaacaaaaacacctaccagtacatgaacggacgggtaacgccgcccggactcgtggacacctacgttaacgtgggcgcgcgctggtcccccgatgtcatggacagcatcaaccccttcaaccaccaccgcaacgccgggctccgctaccgttccatgctccttggcaacggccgctacgtgcccttccacattcaggtgcctcagaaattctttgccattaagaacctgttactgctccccggttcctacacctacgagtggaacttccgcaaggacgttaatatgatcttgcagagctcgctgggcaatgacctgcgagtggacggggcgagcatccgcttcgacagcattaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcgtcggtcagctggcccggcaacgaccgtctgctgacgcccaacgagttcgaaatcaagcgttcggtggacggtgaagggtacaacgtggcccagagcaacatgaccaaggactggttcttaattcagatgctcagccattacaacatcggctaccagggtttctacgtgcccgagaattacaaagaccgcatgtactccttctttagaaacttccaacctatgagccgtcaagtagtagatactgtggcttataaggactactatcaggacgttaagctcccctaccagcacaacaactcagggttcgtgggctacatgggtcccaccatgcgagaggggcaggcctacccggccaattatccctatcccctgatcggggccaccgccgtacccagcctgacgcagaaaaagttcctctgcgaccgggtgatgtggaggatccccttctctagcaactttatgtctatgggctccctcaccgacctggggcagaacatgctgtacgccaactccgctcacgctttagatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcgttttcccggctttatgtccccccacaagccggcctgcgccatcgttaacacggccggacgggagaccgggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttattttaacatgacacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccaaaactgccgcaccagctgcagggctcccatgacgtcgggcgccgatatcttgaagtcgcagttagggccggagctcccgcggctgttccggaacacggggttggcacactggaacaccatcacgctggggttgtggatactagccagggccgtcgggtcggtcacctccgacgcatccagatcctcggcgttgctcagggcgaacggggtcagcttgcacatctgccgcccgatctggggcaccaggtcgggtttgttgaggcaatcgcagcgcagagggatgaggatgcgacgctgcccgcgttgcatgatagggtaactcgctgccaggaactcctccatctgacggaaggccatctgggccttcgtgccctcggtgaaaaagagcccgcaggacttgctagagaatacgttatgaccgcagttgacgtcctccgcgcagcagcgggcgtcttcgttcttcagctgaaccacgttgcggccccaacggttctggaccaccttggctttcgtaggatgctccttcaacgcccgctgaccgttctcgctggtcacatccatttccaccacgtgctccttgcagaccatctccactccgtggaaacagaacaggacgccctcctgccgggtattgcgatgctcccacacggcgcacccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggttccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcggggctcatctcccgcaagtagggggtgatggagcttcccgcttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtgcccgaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgttcgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttttgccgcaccttcaacgccatctgtgatttctacaacaaaaagttcttctggcaaaggtacacaaactgtattttattctaattctacctcatctatcgtgctgaactgcgcctgcgctaacgaacttatccagtggattgcaaacggtagtgtgtgcaagtacttttgggggaacgagatagttagtagaaataacagcctttgcgagcactgcaactcctccacactaatcctttatcccccatttgttactggatggtatatgtgcgtcggctccggtttaaatcctagttgctttaataagtggtttctacaaaaagagacccttcccaacaattctgtttcttttttcaccctgtcctactgctgttctccctctggttactctttcaaacctctaattggtattttagctttgatactcataatctttattaactttataataattaacaacttacagtaaacatgcttgctattctgctcttcactctagcgctcacttactctaatgcaagaacacttttctgcggcgctggctacaatgcaactcttcaaaccgcttacatgccagatcccgaccaaataccgcgtattacatggtacatacagacctccacgcctaactcctcattttatgaaggccaaaaactctgcgacgtctccgacaacaagtcgcacacatttccccacgcttacctacaatttgattgtgtaaacaaaagcctaagactttacaacttaaaacctaaggattctggtttataccatgctgtagttcaaacaaatgagctagaccaacatatggattattttcaggtgacagttgtggaattaccgccgccaaaatgcgaagtttcctcttcttaccttgaggttcaaggcgtagagtcctactgccttatacacatcaattgtagcaactccaaatacccagctagaatttactttaatggtcaggaaagtaatttttttcactatttaacaacaagcggcggtacaaagcctttacctgactatttcacaacagttgttgaattttccacctacaaagaaacgtatgcaaaacgatcttacaatttttcatacccatttaacgacctttgtaatgaaatacaagcgcttgaaactggaactgattttactccaattttcattgctgccatcgttgtgagctttattacaattactattagcctcacattttgctgcttctacaaacgcaaaaaacctaagtttgaaaaacttaagctaaaacctgtcattcaacaagtgtgattttgttttccagcatggtagccgcatttctactcctcctctgcctacccatcattttcgtctcttcaactttcgccgcagtttcccacctggaaccagagtgcctaccgccttttgacgtgtatctgattctcacctttgtttgttgtatatccatttgcagtatagcctgcttttttataactatctttcaagccgccgactatttttacgtgcgttttgcttactttagacaccatcctgaatacagaaatcaaaacgttgcctctttactttgtttagcatgattaaattattgctgttacttacctatttacccctaattaattgtaattgtccattcaccaaaccctggtcattctacacctgttatgataaaatccccgacactcctgttgcttggctttacgcagccaccgccgctttggtatttgtatctacttgccttggagtaaaattgtattttattctacacactgggtggctacatccccgagaagatttacctagatatcctcttgtaaatgcttttcaattgcagcctctgcctcctcctgatcttcttcctcgagctccctctgttgtgagctactttcaactcaccggtggagatgactgactctcaggacattaatattagtgtggaaagaatagctgctcagcgtcagcgagaaactcgagtgatggagtaccttcaactacagcagcttaaggagtcccactggtgtgagaaaggagtgctgtgccatgttaagcaggcggccctttcttacgatgtcagcctccagggacatgaactgtcttacactttgccttcgcaaaaacaaaccttctgcaccatgatgggtcctacctctatcacaatcacccaacaaaccggacctgtcgagggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttgggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctgagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcatgtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttaacagcgagccccaactgggcgtacactttaatccccctatcaccgtgcaacaaggcggtctggccttaaatacgggggatggtttgcaagtatatcttaacaaactaacgctaaacataggcagagacttgcaatatgaaaacgggtcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgagtcagtccggtatttgggagttaagatccaaacagtctctttggtaatcagatgtcgatccgtgatggacacaaatccctggggcaggttctccaacgtttcggtgaaaaactgcgtgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagctctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtataaagccacgaaaaagtcgagctaaaatccacccaacagcctatagctatatatacactccgcccaatgacgctaacaccgcaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccacgtcaccgcacgtcaccgcacgtcaccccggccccgcctcgctcctccccgctcattatcatattggcacgtttccagaataaggtatattattgatgatg

SEQ ID NO: 15 - skipped

SEQ ID NO: 16 - DNA, 1089 bp, Artificial Sequence
  Synthetic oligonucleotide RhAd4282 / RhAd54 Short Fiber
atgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtcctctccgcgtcacagacaacaaacttacatttaacttcacatcaccactccgttatgaaaatgaaaaccttacttttaaatatacagagcctcttaaacttataaataacagccttgccattgacatcaattcctcaaaaggccttagtagcgtcggaggctcacttgctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccacttataaacaacgcctttagtattcgacagaacgacagtacggcctcaaaccctacctacaacgccctggcgtttatgcctaacagtaccatatatgcaagagggggaggtggtgagccacgaaacaactactacgtccaaacgtatcttaggggaaatgttcaaaaaccaatcattcttactgtaacctacaactcagctgccacaggatattccttatcttttaagtggactgctcttgcacgtgaaaagtttgcaaccccaacaacttcgttttgctacattacagaacaa

SEQ ID NO: 17 - DNA, 879 bp, Artificial Sequence
  Synthetic oligonucleotide RhAd4300 / RhAd55 Short Fiber-1
atgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctgagcaggccaattacccttacgctcacactcaactcactccctacaggttacacgcttacattcaagtgggggacttaccttaacgaaccgttctctgtaccaactacgtgtttctgctatgttgcagaacaa

SEQ ID NO: 18 - DNA, 876 bp, Artificial Sequence
  Synthetic oligonucleotide RhAd4300 / RhAd55 Short Fiber-2
atgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcaggtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaa

SEQ ID NO: 19 - DNA, 1089 bp, Artificial Sequence
  Synthetic oligonucleotide RhAd4302 / RhAd56 Short Fiber
atgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtccgctccgcgtcacagacaacaaacttacatttaacttcacatcaccactccgttatgaaaatgaaaaccttacttttaactatacagagcctcttaaacttataaataacagccttgccattgacatcaattcctcaaaaggccttagtagcgtcggaggctcactagctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccgcttataaacaacgcctttagtattcgacagaatgacagtacggcctcaaaccctacctacaacgccctggcgtttatgcctaacagtaccatatatgcaagagggggaggtggtgaaccacgaaacaactactacgtccaaacgtatcttaggggaaatgttcaaaaaccaatcattcttactgtaacctacaactcagccgccacaggatattccttatcttttaagtggactgctcttgcacgtgaaaagtttgcaaccccaacaacttcgttttgctacattacagaacaa

SEQ ID NO: 20 - DNA, 879 bp, Artificial Sequence
  Synthetic oligonucleotide RhAd4305 / RhAd57 Short Fiber-1
atgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagtccgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacagggataaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctaagcaggccaattacccttacgctcacactcaactcactccctacaggttacacgcttacattcaagtgggggacttaccttaacgaaccgttctctgtaccaactacgtgtttctgctatgttgcagaacaa

SEQ ID NO: 21 - DNA, 876 bp, Artificial Sequence
  Synthetic oligonucleotide RhAd4305 / RhAd57 Short Fiber-2
atgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcaggtaacaaacaatagcctcgctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaa

SEQ ID NO: 22 - DNA, 1044 bp, Artificial Sequence
  Synthetic oligonucleotide RhAd4308 / RhAd58 Short Fiber
atgaaaagaactcgagttgacgaagacttcaatcctgtgtatccatatgatactacatctactccagccgttccttttatatcccctccctttgtaaacagtgatggtttacaggaaaacccacctggcatcttaagcctgcgaatagacagacccctttactttaacacacaaagacaattagcactttccctaggaaacgggttagcaatcaccgccgggggtgaactagaaagcacactgagcgttcgacccaatcccccattggttataaatggtaattcgctttcattgcgctactctgatcccctacgcgtggtgaatgacagcctaacatttaatttcacttcaccactccgttttgaaagcgggagtctcacatttcattacgcgtctccccttaaactaatgaatgacagtctcgctctcgacgtggagccttccaaaggtctcagcacagacggcaataaacttgctgttaagctcagctcagacctaaaatttgacaacaatggagctattgctttcggtatacagagtctatggacagctccaactacaactccaaactgcatgacatacgctgaaaatgactcactacttagtctctgtttaaccaaatgcggcgcccacgtactgggaagcgtaagtctcaccgggtttaccggagatctcttgaacatgaagcaaacaacagtgagtatcgaatttcgattcgataataatggcatattgacaacatctccactagtcaacagcagcagttggggcattagacaaaacaacggtatctacccgaaccctgtctacaatgcgctggcttttatgccaaacagcaccgtttactctcgagggggaggtggcgaaccccgaaacaactactacacccaaacataccttaggggcaatactcaaatacccattaccctcaccgtgacctacaactcagctaatacaggatattccttaacgtttaaatggactgcattaacaaaccaaaaatttgccgctccgactgcttccttttgctatatttcagaacaa

SEQ ID NO: 23 - DNA, 879 bp, Artificial Sequence; identical to SEQ ID NO: 17
  Synthetic oligonucleotide RhAd4309 / RhAd59 Short Fiber-1

SEQ ID NO: 24 - DNA, 876 bp, Artificial Sequence
  Synthetic oligonucleotide RhAd4309 / RhAd59 Short Fiber-2
atgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcatgtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaa

SEQ ID NO: 25 - DNA, 777 bp, Artificial Sequence
  Synthetic oligonucleotide RhAd4310B / RhAd60 Short Fiber-1
atgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccact

SEQ ID NO: 26 - DNA, 1077 bp, Artificial Sequence
  Synthetic oligonucleotide RhAd4310B / RhAd60 Short Fiber-2
atgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatccagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaa

SEQ ID NO: 27 - DNA, 936 bp, Artificial Sequence
  Synthetic oligonucleotide RhAd6665 / RhAd61 Short Fiber-1
atgcgatggtgggcagcaaatttcctccaaaccctaaaagaaatattactgtctacttccttattatttcccacaatcttcatcttttcagagatgaaaagaacccgagttgatgaagacttcaatcccgtctatccatataacacagagccgactccctccgctccctttgttactccgccctttgtttcgtccaatggactcatggaatccccatcaggggtattatccattcgttacacccaacccattactgtagttaacaattccctaagtctaaaaacaggaaatggtttgtctgtgagtagtgatgggaaactgcaaattgccataaacactaacaaaggactaagtaatgaggataacaagattgctgttaaggttggtcctgaactatatttcgacgctgacggtgctatcaccatgaattctcaaactctttggaccaatccgaacgaaactgcaaactgtagcgtctttcaaagcttagactccttattaactttatgtttaactaaaaacggagcccacgtattaggaagcgtaagcttaaccggcctttctggccccctattaaaaatgaccacaacctcagttaccgttcaactaatctttgacagcaacggagtccttactacttcccaacttaatactaactcttggggcatgcgcgcgaacacaaatctaaatgctccagttacaaacgccttaccatttatgcccaacagtactatttatgcaagaggaaacgcaggagaacccagaagcaactactacgtacaaacatacttacgaggcaacctaaataaacaaatcactcttagtatttcattcaacgcttcttcctcaggctactccttaacatttaaatggagtgccattgccacagaaaagtttgccacccctacatcgtcgttctgttacatcgcagaacaa

SEQ ID NO: 28 - DNA, 873 bp, Artificial Sequence
  Synthetic oligonucleotide RhAd6665 / RhAd61 Short Fiber-2
atgaagcgaacccgaattgaagacgatttcaaccctgtttacccctacgactcagtttctgctccagcagttccatttgtatcccctccatttgtaaacagtgatggtttaaaagaaagtcctcctggagtattaagtttgcaaattgccaaacctctgctctttgatgcgcaaagaaaagtcactctctctttgggtcgaggactagccgttaattcagccggacaactagaaagtacgcaaatcctccaaactaaccctccattgttactatccaacaacatgctttccttagactgtgcttttcccctatctgtagcgaacaaccaactatcccttaaatacacagatccactccgtttagttaatgacagtctcacattcaattttacatctccgcttcatttggctaacggtaaccttacctttagttacacaactcctcttaatattattaacaacagtttagccttaaactattcaccccctctacgacttgtaaacagcaatcttactatggggtacgccgatccatttcaagtggcaaactcaaacctatctctaaaaatcgctaacccttcaggactccgcattcgaaacggtaacttgcaaattgccgctggttatggcttacaaattgcaggtaataacgacctatatgtaagacgagaaacacctctagacgtttacacatctggagcaaaagaaggaatattatacctccggttaggccctaactctggattgcaagttcttagtgacaaccttagtctcaaaaccggtcaaggactgcaaattttgagcaacaccctgtctgttaaactaggacgtggtttacgctttgacagcagcggagccattgaacttagcaca

SEQ ID NO: 29 - DNA, 1092 bp, Artificial Sequence
  Synthetic oligonucleotide RhAd6666 / RhAd62 Short Fiber
atgaaaagaaccagagttgatgaagacttcaaccccgtctacccttatgactccacatccactcctgcggtcccctttatatcccccccgtttgtaaacagcgatggtcttcaggaaaaccctcctggagtcttaagtttacgaatagctaaacccttgtattttgacatggaaaggaaactagcgctttcacttggaagaggattggcaattacctccaccggacagctagaaagcacacagagcgtgcaaaccacccctccattagttgtcaataacagcaacacgcttgtcctgcgttattcctccccgttaggcttatcgggtgacaatttaatactaaattgctccgatcctctccgcgtaataaacaacagcctcacattcagctacctatctccacttcgttttgaaggtggcagtcttacattcaattacacatctccccttaaactgttgaacagcagccttgcgatcggaataaattccaacaaaggtctcggcaatgacagcgatgaactttctgtcaaactaacatcagatctgaagtttaacaacgatggaaaaatagcttttggtatacaaagcctgtgtaccacccccacagccgcctctaactgtaccgtttttaccaacggtgattctttactctgtttatgtttaaccaaatgtggagctcacgtgttaggaagtgtgagtttaaccggaatgcaaggaaccataacagccatgacacagaactacattagtattcaatttctatttgaccacaatggtgcgttgacttcatcaccgctcctcaacaacaacacttggggtatacggcaaagcgacacttcgtccgctaaccccgcctacaatgctcttgcatttatgcctaacagcactgtatatgtaagaggtcaaagtggtgagcccagaaataactattacacccaaacataccttaggggaaacgttaaaaagccaattatccttaccgttacctacaactcggctgcttcaggttattcactaacttctaaatgggatgctgtggtaacagaaaaatttgccactccaacatcttctttttgctatattacagaacaa

SEQ ID NO: 30 - DNA, 777 bp, Artificial Sequence; identical to SEQ ID NO: 25
  Synthetic oligonucleotide RhAd6668A / RhAd63 Short Fiber-1

SEQ ID NO: 31 - DNA, 1077 bp, Artificial Sequence; identical to SEQ ID NO: 26
  Synthetic oligonucleotide RhAd6668A / RhAd63 Short Fiber-2

SEQ ID NO: 32 - DNA, 777 bp, Artificial Sequence; identical to SEQ ID NO: 25
  Synthetic oligonucleotide RhAd6668B / RhAd64 Short Fiber-1

SEQ ID NO: 33 - DNA, 1077 bp, Artificial Sequence
  Synthetic oligonucleotide RhAd6668B / RhAd64 Short Fiber-2
atgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatccagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccacgcctacatcttcattttgctacatttcagaacaa

SEQ ID NO: 34 - DNA, 777 bp, Artificial Sequence; identical to SEQ ID NO: 25
  Synthetic oligonucleotide RhAd6669 / RhAd65 Short Fiber-1

SEQ ID NO: 35 - DNA, 1077 bp, Artificial Sequence
  Synthetic oligonucleotide RhAd6669 / RhAd65 Short Fiber-2
atgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatcgagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaa

SEQ ID NO: 36 - DNA, 777 bp, Artificial Sequence
  Synthetic oligonucleotide RhAd6672 / RhAd66 Short Fiber-1
atgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcggccgcaaacccactccttcttcaaaataacacactgagtcttatttccagtgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccact

SEQ ID NO: 37 - DNA, 1077 bp, Artificial Sequence
  Synthetic oligonucleotide RhAd6672 / RhAd66 Short Fiber-2
atgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacataaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatctatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggcgccctgcttaacatgactcaaacctctgtaacaatccagttcacatttgataatactggttcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccaattgtcctaacggttacctacaactctgccaatacaggatattccttatcgtttaaatgggatgctattgcaaccgaaaaatttgccactcctacatcttcattttgctacatttcagaacaa

SEQ ID NO: 38 - DNA, 672 bp, Artificial Sequence
  Synthetic oligonucleotide RhAd6673 / RhAd67 Short Fiber-1
atgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttgggcatacgtcaaactcctaactctccaaacgctgttaatttgcttacatttatgcccagcagct

SEQ ID NO: 39 - DNA, 876 bp, Artificial Sequence; identical to SEQ ID NO: 24
  Synthetic oligonucleotide RhAd6673 / RhAd67 Short Fiber-2

SEQ ID NO: 40 - DNA, 1200 bp, Artificial Sequence
  Synthetic oligonucleotide RhAd4282 / RhAd54 Long Fiber
atgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacaattaaactaggaaacggcctcactctagacaaccagggacaactaacatcaaccgctggggaagtagaacctccactcactaacgctaacaacaaacttgcactggtctatagcgaacctttagcagtaaagcgcaacagcctaaccttatcgcacaccgctccccttgttattgctgataactctttagcattgcaagtttcagaacctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatactggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcgatggaaacatagctgtttctcctcaagttacatcgcctgacaccttatggaccactgccgatccatccccaaattgttccatctacact

SEQ ID NO: 41 - DNA, 1665 bp, Artificial Sequence
  Synthetic oligonucleotide RhAd4300 / RhAd55 Long Fiber
atgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttaacagcgagccccaactgggcgtacactttaatccccctatcaccgtgcaacaaggcggtctggccttaaatacgggggatggtttgcaagtatatcttaacaaactaacgctaaacataggcagagacttgcaatatgaaaacgggtcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaa

SEQ ID NO: 42 - DNA, 1680 bp, Artificial Sequence
  Synthetic oligonucleotide RhAd4302 / RhAd56 Long Fiber
atgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacagttaaactaggaaacggcctcactctagacaaccagggacaactaacatcaaccgctggggaagtagaacctccactcactaacgctaacaacaaacttgcactggtctatagcgatcctttagcagtaaagcgcaacagcctaaccttatcgcacaccgctccccttgttattgctgataactctttagcattgcaagtttcagagcctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatagtggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcaatggaaacatagctgtttctcctcaagttacatcgcctgacaccttatggaccactgccgatccatcccccaattgttccatctacactgatttagatgccaaaatgtggctctcgttggtaaaacaagggggtgtggttcacggttctgttgctttaaaagcattgaaaggaaccctattgagtcctacggaaagtgccattgttattatactacattttgacaattatggagtgcgaattctcaattatcccactttgggcactcaaggcacgttgggaaataatgcaacttggggttataggcagggagaatctgcagacactaatgtactcaatgcactagcatttatgcccagttcaaaaaggtacccaagagggcgtggaagcgaagttcagaatcaaactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaa

SEQ ID NO: 43 - DNA, 1665 bp, Artificial Sequence
  Synthetic oligonucleotide RhAd4305 / RhAd57 Long Fiber
atgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttgacagcgagccccaactgggcgtacactttaatccccctatcaccgtgcaacaaggaggtctggccttaaatacaggggatggtttgcaagtatatcttaacaaactaacgctaaacataggcagagacttgcaatatgaaaacggctcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaa

SEQ ID NO: 44 - DNA, 1677 bp, Artificial Sequence
  Synthetic oligonucleotide RhAd4308 / RhAd58 Long Fiber
atgaaacgggtccgaatcgatgaagacttcaacccagtatacccttatgaccccccatacgctcccgttatgcccttcattactccgccttttacctcctcggatgggttgcaggaaaaaccacttggagtgttaagtttaaactacaaggatcccattactacacaaaatggatctctcacgttgaaaataggaaacggcctcactctagacaaccagggacaattaacatcaactgctggggaagtagagcctccgctcactaatgctaacaacaaacttgcactagcctatagcgaaccattagcagtgaaaagcaaccgcataactttatcacacaccgccccccttgtcgttgctgatgattctttagcgttgcaagtttcagaacctatttttatagatgacgatgacaagctagccctgcagacagccgccccccttgtaactaacgctggcacccttcgcttacagagcgccgcccctttaggattggttgaaaatactcttagactgctgttttctaaacccttgtatttgcaaaatgattttcttgcattagccattgaacgccccctggctatagcagccgcaggtactctagcactacaactcactcctccattaaagactaacgatgacgggctaacactatccacagtcgagccattaactgtaaaaaacggaaacctaggcttgcaaatatctcgccctttagttgttcaaaacagcagcctttcgcttgctattacccccccgctgcgtctatttaacagcgaccccgttcttggtttgggctttacttttcccctagctgtaacaaacaacctactctccttaaacatgggagacggtgttaaactaacctacaataaactaacagccaatttgggtagggatttacaatttgaaaacggtgccattgccgtaacgcttactgctgaattacctttgcaatacactaacaaacttcaactgaatattggagctggccttcgttacaatggagccagcagaaaactagatgtaaacattaaccaaaataagggcttaacttgggacaacgatgcagttattcccaaattaggatcaggtttacaattcgaccctaatggtaacatcgctgttatccctgaaaccgtaaagccgcaaacgttatggacaactgcagatccatcgcctaactgctcagtgtaccagaacttggacgccaggctgtggctcgctcttgttaaaagtggtgacatggttcatggaagcattgctctaaaagccctaaaaggaacgttgctaaatcctacagcaagctacatctccattgtgatatatttttacagcaacggagtccggcgtaccaactatcccacgtttgacaacgaaggcaccttagctaacagcgctacctggggataccgagaggggcaatctgctaacactaatgtaaccaatgccactgaatttatgcccagctcaaccaggtaccccgtgaataaaggagacaatattcagaatcaatctttttcatacacctgtatcaaaggagattttgctatgcctgtcccgttccgagtaacatataatcatgccctggaaggatactcccttaagttcacctggcgcgttgtagccaaccaagcttttgatattccttgctgttccttttcatacatcacagaa

SEQ ID NO: 45 - DNA, 1665 bp, Artificial Sequence; identical to SEQ ID NO: 41
  Synthetic oligonucleotide RhAd4309 / RhAd59 Long Fiber

SEQ ID NO: 46 - DNA, 1779 bp, Artificial Sequence
  Synthetic oligonucleotide RhAd4310B / RhAd60 Long Fiber
atgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaa

SEQ ID NO: 47 - DNA, 1680 bp, Artificial Sequence
  Synthetic oligonucleotide RhAd6665 / RhAd61 Long Fiber
atgaaacgagctcgaattgaggaagacttcaatcctgtgtacccttacgatcccccatatgctcccatcatgccattcattacacctccatttacctcgtctgatggcttgcaagaaaaaccttttggtgttttaagtttaaactacaaaaatccgattactactcaaaatggttctttaactctcaaactaggaaatggcctcaacattaataatcaaggagaactcacctcaacagcaggcgcagtgcaaccccctctcactaatgccgacaacaaattaaccctagcatacagcgagcctttaacagtacaaaacaaacgcctaacgctctcccacagcgcccctctagcggttgctgacaattctttaagtttacaagtcacagaccctattttcataaatgctgacaacaaactagctttacaaacagacgccccacttaacacaactaccggagtccttcgcctgaaaagcgccgcacccttagggcttgtagaacaaaccctaaacctgttgtttgccaaacccttatatttacagggtgacttcctagcattagccattgaacgcccgctagcagtgactgcggacggttcgctagccctggcacttgatccgcccctgaaaaccagtaacacggggttaggactcttaactgccgctccgctcacggttacaaatggaaacctgaacttaaatgttaaacgcccctttgttatacaagacaatagtctttacatggactttagagctccactgcgactgtttaacagcgagccgcaactaggagttaacttcacttcccctcttacggtacgggcagatgccttaacattagacactggaaacggattgcaggtgctttttaacaaactcacattaaatctcggaagagatttggaatatgacaatggagctatagccgttaggttaaacccagctgcccctcttcagtataccaaccagcttcaacttaacctgggagctggcctgcgcttaggtgtttctaagaaattaacagtagatgtggatgaaaataaaggattaacatggaatggtaatcaacttgtggcaagcctaggtactggattagcttttgacaactatggaagaataagtgttgtttcgacagccgctggcgatgatactctgtggacaacggctgacccatcacccaactgtacggtgtatgaacaactagatgctaggctgtggctaagtcttgttaaatgtggcggtatggttcagggaagtgttgctttaaaagccgaaaaaggccgcttgcttaatcccactgcttcttttatttctattgttatgtacttcaatagatatggcgtttggcgcaccgactatcccacaattggtgatgaccaaggcattatagctaacagtgccacatggggatacagacgtggagaatccgccgacacaaacgtcactaacgctttaaaatttatgcctagctcacgaaggtatcctattaaccagggaaataacattcagaaccaaatgattacatacacctgcatacagggagatgttagcatgcctgtgcctttaaaaatcacctttaatcatgcttttgagggttactccttcaaatttacttggcgtgtggtcgccaatcaaaggtttgatattccctgttgttcattttcttacatcacagaagaa

SEQ ID NO: 48 - DNA, 1677 bp, Artificial Sequence
  Synthetic oligonucleotide RhAd6666 / RhAd62 Long Fiber
atgaaacgggccagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacggctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggtgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaa

SEQ ID NO: 49 - DNA, 1587 bp, Artificial Sequence
  Synthetic oligonucleotide RhAd6668A / RhAd63 Long Fiber
atgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactatgccaatttttttccaagtccagtacaattatgtaaccactggatattccttcaaattcacttggcaagctgtacaaaggcaaaagtt

SEQ ID NO: 50 - DNA, 1779 bp, Artificial Sequence
  Synthetic oligonucleotide RhAd6668B / RhAd64 Long Fiber
atgggatgctattgcaaccgaaaaatttgccacgcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaa

SEQ ID NO: 51 - DNA, 1779 bp, Artificial Sequence
  Synthetic oligonucleotide RhAd6669 / RhAd65 Long Fiber
atgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgaaccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaa

SEQ ID NO: 52 - DNA, 1779 bp, Artificial Sequence
  Synthetic oligonucleotide RhAd6672 / RhAd66 Long Fiber
atgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggtaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttgacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaagggaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaa

SEQ ID NO: 53 - DNA, 1665 bp, Artificial Sequence; identical to SEQ ID NO: 41
  Synthetic oligonucleotide RhAd6673 / RhAd67 Long Fiber

SEQ ID NO: 54 - DNA, 2793 bp, Artificial Sequence
  Synthetic oligonucleotide RhAd4282 / RhAd54 Hexon
atggccaccccatcgatgatgccgcagtggtcttacatgcacatcgccgggcaggacgcctcggagtacctgagccccggtctcgtgcagttcgcccgcgccaccgacacctacttcagcttgggaaacaagtttagaaaccccaccgtggcccccacccacgatgtaaccacggaccgctcgcaaaggctgaccctgcgttttgtgcccgtagaccgggaggacaccgcgtactcttacaaagtgcgctacacgctggccgtaggggacaaccgagtgctggacatggccagcacctactttgacatccggggagtgctggatcgcggtcccagttttaagccctactcgggtaccgcgtacaattccctggctcccaagggcgctcccaaccctgcagaatggacgaattcagacagcaaagttaaagtgagggcacaggcgccttttgttagctcgtatggtgctacagcgattacaaaagagggtattcaggtgggagtaaccttaacagactccggatcaacaccacagtatgcagataaaacgtatcagcctgagccgcaaattggagaactacagtggaacagcgatgttggaaccgatgacaaaatagcaggaagagtgctaaagaaaacaacgcccatgttcccttgttacggctcatatgccaggcccactaatgaaaaaggaggacaggcaacaccgtccgctagtcaagacgtgcaaaatcccgaattacaattttttgcctctactaatgtcgccaatacaccaaaagcagttctatatgcggaggacgtgtcaattgaagcgccagacactcacttggtgttcaaaccaacagtcactgaaggcattacaagttcagaggctctactgacccaacaagctgctcccaaccgtccaaactacatagcctttagagataattttattggtctcatgtactacaatagcacaggtaacatgggagtactggcaggccaggcttctcagctaaatgcagttgttgacctgcaagacagaaatactgagctgtcctaccaactcatgttggacgccctcggagaccgcagtcggtacttttctatgtggaaccaagctgtggatagttacgatcctgatgtaagaatcatagaaaaccatggcgtagaagatgaattgcctaattattgctttcctttgggaggcatggcagtaaccgacacctactcgcctataaaggttaatggaggaggcaatggatgggaagccaataacggcgttttcaccgaaagaggagtggaaataggttcagggaacatgtttgccatggagattaacctgcaagccaatctgtggcgcagtttcttgtattccaatatcgggctgtatctcccggactctttaaaaatcactcctgacaacatcacgctgccagaaaacaaaaccacctaccagtacatgaacggccgcgtaacgccacccgggctggtggacacctacgttaacgtgggcgcgcgctggtcccccgatgtcatggacagtattaacccttttaatcaccaccgcaacgccggactccgctaccgttccatgctcctgggaaacggacgctacgtgcccttccacattcaggtgccccagaaattctttgcaattaaaaacctgctgctgctccccggttcctatacctacgagtggaacttccgcaaggacgtgaacatgattttgcagagctcgctgggtaacgacctgcgagttgacggggccagcatacgcttcgacagcatcaacctgtatgctaactttttccccatggcccacaacacggcctccaccctggaagccatgctgcgcaacgacaccaatgaccagtccttcaacgactacctgtgcgcagctaacatgctgtaccccatccccgccaacgccaccagcgtgcccatctccatcccgtctcgcaactgggccgcctttaggggttggagtttcacccgcctcaaaaccaaggaaaccccctcgctgggctccgggttcgacccctacttcgtctactccggctccatcccctacctggacggcaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctggttcaaatgctcagccattacaacatcggctaccagggcttctacgtgcccgagaattacaaggaccgcatgtactccttctttagaaacttccaacccatgagccgccaaatagtagactcaacggcttacactaactatcaggatgtgaaactgccataccagcataacaactcagggttcgtgggctacatgggacccaccatgcgagagggacaggcctacccggccaactatccgtaccccctgattggggccaccgccgtgcccagcctgacgcagaaaaagttcctctgcgaccgggtgatgtggaggattcccttctctagcaacttcatgtctatgggttccctcaccgacctggggcagaacatgctgtacgccaactccgctcacgccttggacatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 55 - DNA, 2796 bp, Artificial Sequence
  Synthetic oligonucleotide RhAd4300 / RhAd55 Hexon
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggatcgctcgcagaggctgaccctgcgcttcgtgcccgtagaccgggaggacaccgcgtactcttacaaagtgcgctacacgctggccgtaggggacaaccgggtgctcgacatggccagcacctactttgacatccggggggtgctcgatcgcggtcccagcttcaagccctattcggggaccgcctacaactccctggctcccaagggcgcccccaaccccgctgaatgggcagattctgacagcaaactgaaagtgagggcacaggcaccttttgtcagctcctacggtaataatgcgattacaaaggaaggtattcaggtaggagtaattttaacagactccggacaaacagcacaatatgcggacaaaacgtatcagcctgagccgcagattggagaactacagtggaacagcgaagtaggaaccaatgataaagtagcgggaagggtgcttaagaagacgactccaatgtttccctgttatggttcatacgccaagcctaccaatgcaaaaggagggcaggcgacacagcctgctagtcaagaaactcaaaatccagaattgcagttttttgctgcttccagcaccaccgtcaacactccaaaagcagtattatacgcagaggacgtgtctattgaagctccagacactcacctggtatttaaaccatcagtaactgaaggaactacaagttcggaagctctactgacacaacaagctgcccctaacaggccaaactatattgcctttcgggacaattttattggcctaatgtattacaatagcactggaaacatgggagtgctggccggacaggcgtcgcaactcaatgcggtggtcgatttgcaagacagaaacacagaactgtcataccagctaatgcttgacgctctgggagatagaagtcgctacttctctatgtggaatcaagccgtggacagttacgatccagatgttagaatagtggaaaatcacggcgtcgaagatgaattgcctaattactgcttccctttgggcggtatggcagtgactgacacctactcgcctataaagcttaatggtgggcaaaacggatgggaagctaataatgacgtttatgccgaaagaggagtggaaataggctcagggaacctgttcgccatggagatcaacctgcaggccaacctgtggcgcagtttcttgtattccaacatcgggctgtatctccccgactccctaaaaatcacccccgacaatatcacgctgccagagaacaaaaacacttatcagtacatgaacggtcgcgtgacacctcccgggctcatagacacctacgtcaacgtgggtgcgcgctggtcccccgatgttatggacagcatcaaccccttcaaccaccaccgcaacgcggggctgcgttaccgctccatgctgctgggcaacggccgctacgtgcccttccacatccaggtgccccagaaattctttgccattaagaacctgctgctgctccccggttcctacacctacgagtggaacttccgcaaggacgtcaacatgatcttgcagagctcgctgggcaatgacctgcgagtggacggggccagcatccgcttcgacagcatcaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtgatgtggaggatccccttctctagcaacttcatgtcgatgggctccctcaccgacctggggcagaacatgctgtacgccaactccgcgcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 56 - DNA, 2793 bp, Artificial Sequence
  Synthetic oligonucleotide RhAd4302 / RhAd56 Hexon
atggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacgatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacc

SEQ ID NO: 57 - DNA, 2754 bp, Artificial Sequence
  Synthetic oligonucleotide RhAd4305 / RhAd57 Hexon
atggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccccaccgtggcccccacccacgatgtaaccacggaccgctcgcagaggctgaccctgcgctttgtgcccgtagaccgggaggacaccgcgtactcttacaaagtgcgctacacgctggccgtaggggacaaccgagtgctggacatggccagcacctacttcgacatccggggggtattggatcgcggtcccagtttcaagccctactccggcaccgcttacaactccttggcccccaagggcgcccctaacccttcagaatgggaagggtcagacaacaaaacacacgttagaggtcaagcgccctttattagcgatgaaattacaaaggagggcataaaagtaggcactgatactggaaaccccggacaggcaatttatgctaaaaaagcttaccagccggaaccccaggtgggagaaacacaatggaacagcgacgtgggaacaaacgacaaagcggcaggacgaattttaaagaaaacaacacccatggttccgtgctacgggtcttacgccaagcccacaaacgaagaaggggggcaggctacaaaccaacaagtagatttgcagtttttctcaacgggtagctccaatacaactcccaaagttgtgctgtattccgaagacgtttctcttgaaacgccagacacccacctggtgtttaaaccaacagttactgcgggcgtcacaaatgcagaagctttgttagcgcagcaagctgctccgaatcgtccaaactacattgcattcagagataacttcattggacttatgtactacaacagtacaggaaatatgggagtgctggccggtcaggcttcgcagttgaacgctgtagtggatttgcaagacagaaacactgaactgtcatatcagctaatgttggatgctttaggtgacagaagcaggtacttttcaatgtggaatcaagccgtggacagttatgaccctgatgtaagaattgtggaaaatcatggagtagaagacgaattacccaactattgttttccgctggggggcatggcagtcaccgatacctactcaggcataaaaccttcagataacggaggtacatttcaggcagataacactgttgcagatagagtagaaataggttcaggaaacatgttcgccatggaaatcaatttgcaagccaacctgtggcggggtttcttatactccaatatcggactgtacctcccagacacgctaaaactcacccccgacaacatcacgctcccagagaacaaaaacacctaccagtatatgaacggtcgagtcacgccccccgggctcgtggacacctacgttaacgtgggcgcgcgctggtcccccgatgtcatggacagtattaacccttttaatcaccaccgcaacgccggactccgctaccgttccatgctcctgggaaacggacgctacgtgcccttccacattcaggtgccccagaaattctttgcaattaaaaacctgctgctgctccccggttcctatacctacgagtggaacttccgcaaggacgtgaacatgattttgcaaagctcgctgggtaacgacctgcgagttgacggggccagcatacgcttcgacagcatcaacctgtatgctaactttttccccatggcccacaacacggcctccaccctggaagccatgctgcgcaacgacaccaacgaccaatcttttaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggaaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtgatgtggaggatccccttctctagcaactttatgtcgatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 58 - DNA, 2793 bp, Artificial Sequence
  Synthetic oligonucleotide RhAd4308 / RhAd58 Hexon
atggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccccaccgtggcccccacccacgatgtaaccacggaccgctcgcagaggctgaccctgcgctttgtgcccgtagaccgggaggacaccgcgtactcttacaaagtgcgctacacgctggccgtaggggacaatcgagtgctggacatggccagtacctactttgacattcgaggggtgctggatcgcggccccagtttcaagccctactccggcaccgcttacaactccctggctcccaagggcgctcccaatcctgcagaatggacaaatactgacagcaaagtcaaagtgagggcgcaagcgccttttgttagctcttacggcgctacagcaattacaaaggagggcgttcaggtgggagtagtcttaacagactcgggatcgacaccacagtatgcggataaaacgtatcagcctgagccgcaaatcggcgagcagcagtggaacagcgatgttggaaccaatgacaaaatagcgggaagggtgttaaagaaaacaactcccatgttcccttgttacggctcatatgccagacccaccaacgaaaaaggagggcaggcgacaccgtccgctagtcaagacgtgcaaaatcccgaattacaatttttcgcctctactaatgtcgccaataccccaaaagcagtactatatgcagaggatgtggcaattgaagccccagacactcacttggtgttcaaaccaacagtaactgaaggaataacaagttcagaagctcttctgacccaacaagctgctcccaaccgaccaaactacatagcctttagagataattttattggtctgatgtactacaatagcactggcaacatgggagtgctagccggacaggcttctcagttgaatgccgttgttgacttgcaagacagaaatactgagctgtcttaccaactcatgttggacgccttgggagaccgcagtcggtacttctctatgtggaaccaagctgtagatagctatgatcctgacgtaagaataatagagaatcacggtgtggaagatgaattgcctaattactgcttccctttgggcggcatggcagtaactgacacctactcacccataaaggtcaatacagcagggaacggatgggaagccaataatgacgtttttaccgacagaggagttgaaataggttcaggcaatatgttcgccatggagattaacctgcaagccaacctgtggcgcagctttttgtattccaacatcgggctctatctcccagactctctgaaaatcacccccgacaacatcacactcccagagaacaagaacacctatcagtacatgaacggccgcgtaacaccacccgggctcgtagatacctacgtgaacgtgggagcgcgctggtcccccgatgtcatggacagcatcaaccccttcaaccaccatcgcaacgccgggctgcgctaccgctccatgctcctcggcaacggccgctatgtacccttccacattcaggtgccgcaaaagttttttgccattaagaacctgctgctgctccccggttcctatacctacgagtggaacttccgcaaggacgttaacatgatcttgcagagctcgctgggcaatgacctgcgtgtggacggggccagcatccgctttgacagtatcaacctctatgccaactttttccccatggcccacaacacggcttccaccctggaagccatgctgcgcaacgacaccaacgaccagtccttcaacgactacctgtgcgcggccaacatgctgtaccccatccccgccaacgccaccagcgtgcccatctctatcccctctcgcaactgggccgccttcaggggttggagtttcactcgcctcaaaaccaaggaaaccccctcgcttggctccggttttgatccctactttgtttactccgggagcattccctacctggatggcactttctacctcaaccacactttcaaaaaggtgtccatcatgtttgattcgtcggtgagttggcccggcaacgaccgcctgctaacgcccaacgaattcgaaatcaagcgttcggtggacggcgaagggtacaacgtggcccagagcaacatgacgaaggactggttcctcattcagatgcttagccattacaatattggctaccagggtttctacgtgcccgagaactacaaggatcgcatgtactccttttttagaaacttccaacccatgagccgccaaattgtagattccacgtcttacactaattaccaggatgtaaaactaccgtatcagcacaacaactcagggttcgtggggtatatggggcccactatgagagaagggcaggcttatccggccaattacccttaccccctaatcggcgccaccgctgtgcccagcttgacgcagaagaagttcctctgcgatagggttatgtggagaatccccttctctagcaactttatgtccatgggggccctcaccgatctggggcagaacatgctgtacgccaactccgcccacgccttggacatgacctttgagctggatcccatggatgagcccacacttctctatgttctgtttgaagtcttcgacgtggtgcgcattcaccagccgcaccgcggcgtcatcgaggccgtctacctgcgcacacctttctctgccggtaacgccaccacc

SEQ ID NO: 59 - DNA, 2757 bp, Artificial Sequence
  Synthetic oligonucleotide RhAd4309 / RhAd59 Hexon
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggtgctccaaacccatcagagtggaacggaactgacagcaaaaccaatgtcagaggtcaagcaccattcattagtgatgcaataactaaagagggcataaaagttggtacagacacaggaaaccacggacaagcaatttatgctaaaaaagagtatcagcctgaaccccaagtgggggaaacgcaatggaatagcgacgttggagcaacagacaaagcggcaggacgaattttaaagaaaacgacacccatggttccgtgctatgggtcttatgccaaacccacaaacgaagaagggggtcaggctacaaaccagcaggtagatatgcagttttttgctaccggcagttctaatactacaccaaaggttgtgctgtactctgaagacgtgacgattgagacgcccgacacccacttagtatttaagccaattgtaacagcaggaaccacaaatgcagaagctttgttagcgcagcaagctgctcccaatcgaccaaactacattggctttagagataattttattggtcttatgtactacaacagcactggaaacatgggagtgctggctgggcaggcttcgcagttaaacgctgtggttgatttgcaagacagaaacactgagctatcttatcaactaatgctggatgctttgggggatagaagcagatacttttcaatgtggaatcaagcggtggacagttacgatcccgatgtgagaattgtagaaaaccacggagtagaggacgagttaccaaattactgtttcccgttaggcggtatggcagtaactgatacctacacaggtattaaacctgataatggaggcactacattctcaaatgatgacacttttgcaactagaggaatagaaataggttctggaaacatgttcgccatggagattaatctgcaggctaatctgtggcgtagtttcttgtattccaacatcgggctgtaccttccagacaccttgaaaatcactcccgacaacataacgttgccggacaacaaaaacacctaccagtacatgaatggtcgtgtcactccccccgggcttgtggacacctacgtgaacgtgggtgcgcgctggtcccccgacgtcatggacggcattaaccccttcaaccaccaccgcaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcagctaacatgctgtaccccatccccgccaatgccaccagcgtgcccatctctattccttctcggaactgggctgccttcaggggctggagttttactcgcctcaaaaccaaggagactccctcgctgggctccggttttgacccctactttgtttactccggctccattccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggttcctaattcaaatgctcagtcactataatataggttaccagggcttctatgtgcccgagaactacaaggaccgcatgtactccttcttccgcaacttccaaccaatgagccggcaggtggtagataccgtgacttatacagactacaaggatgtcaagctcccctaccaacacaacaactcagggttcgtgggctacatgggacccaccatgcgagaggggcaggcctacccggccaactatccttatcccctaatcggagagactgctgtacccagcctgacgcagaaaaagttcctctgcgaccgggtgatgtggaggatccccttctctagcaactttatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 60 - DNA, 2763 bp, Artificial Sequence
  Synthetic oligonucleotide RhAd4310B / RhAd60 Hexon
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggagctcccaacccctcggaatggacggacacttccgacaacaaacttaaagcatatgctcaggctccctaccagagtcaaggacttacaaaggatggtattcaggttgggctagttgtgacagagtcaggacaaacaccccaatatgcaaacaaagtgtaccaacccgagccacaaattggggaaaaccaatggaatttagaacaagaagataaagcggcgggaagagtcctaaagaaagatacccctatgtttccctgctatgggtcatatgccaggcccacaaacgaacaaggagggcaggcaaaaaaccaagaagtagatttacagttttttgccactccgggcgacacccagaacacggctaaagtggtactttatgctgaaaatgtcaacctggaaactccagatactcacttagtgtttaaacccgatgacgacagcaccagttcaaaacttcttcttgggcagcaggctgcacctaacagacccaactacataggttttagagataattttattggtttaatgtactacaatagcactggaaacatgggcgtgctggccggacaggcttctcaattgaatgccgtagtcgacttgcaggacagaaacaccgagttgtcctaccagctgatgctggacgcactgggggatcgcagccgatatttttcaatgtggaatcaggcagtagacagctatgacccagacgttagaattatagaaaaccacggagtggaagacgaactgccaaactattgttttcctctgggaggaatggtggtgactgacaattacaactctgtgacgcctcaaaatggaggcagtggaaatacatggcaggcagacaatactacatttagtcaaagaggagcgcagattggctccggaaacatgtttgccctggaaattaacctacaggccaacctctggcgcggcttcttgtattccaatattgggttgtatcttccagactctctgaaaatcacccccgacaacatcacgctgccagaaaacaaaaacacttatcagtacatgaacggtcgcgtaacgccacccgggctcatagacacctatgtaaacgtgggcgcgcgctggtcccccgatgtcatggacagcattaaccccttcaaccaccaccgtaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcggctaacatgctgtaccccatccccgccaacgccaccagcgtgcccatctctattccttctcggaactgggctgccttcaggggctggagttttactcgcctcaaaaccaaggagactccctcgctgggctccggttttgacccctactttgtttactccggctccattccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggtttctaattcaaatgctcagtcactataatataggttaccagggcttctatgtgcccgagaactacaaggaccgcatgtactccttcttccgcaacttccaaccaatgagccggcaggtggtagataccgtgacttatacagactacaaagatgtcaagctcccctaccaacacaacaactcagggttcgtgggctacatgggacccaccatgcgagagggacaggcctacccggccaactatccctaccccctgatcggagagactgccgtacccagcctcacgcagaaaaagttcctctgcgaccgggtgatgtggaggatacccttctctagcaactttatgtcgatgggctccctcaccgacctggggcagaacatgctgtacgccaactccgctcacgccttggacatgacttttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 61 - DNA, 2811 bp, Artificial Sequence
  Synthetic oligonucleotide RhAd6665 / RhAd61 Hexon
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctacttcgacatccggggggtgctggataggggtcctagcttcaagccctactccggcaccgcttacaactccctggcccccaagggcgcccctaaccctgcagaatgggaagatactaatgacagcaacaaactcaaagtgaggggacaggcgccttatgttagcacgttcggcgccgctacggcgcttacaaaagatggcattcaggtgggagtgaccgtatcagagtccgcacgaactccgcagtacgcggacaaaagttaccaaccagaacctcaaattggggagacagagtggaacagcgaagtaggtaacgatgacaaattagcaggcagggtgctaaaaaaatcaacgccaatgttcccttgttacggatcatatgccaaacccaccaacgaaaaaggcggacaagcaatacagcctgccggcagcagcggagacactaatccggcagtagagttgcagttcttcgccactactagcgctactactactccaaaagcagtgttatatgcagaggacgtagccatagaagcaccagatactcatttggtgtttaagccgacagtaactgcaggaactacaagttcggaagctctgttaacccaacaagctgcacctaaccgtccaaactacattgcattcagagataacttcattggacttatgtactacaacagtacaggaaatatgggagtgctggccgggcaggcatctcagctaaatgcagtggttgatttgcaagacagaaacactgaactgtcttaccagctaatgttggatgctctcggagaccgcagtcggtacttctctatgtggaatcaagcagtggacagttacgatccagatgttagaattgtggaaaatcacggagtggaggatgagttaccaaattattgctttcctttgggagggatggtagtaactgacacctacacgcccataaaacccaatggcagtggaagtgtcacgtggacagccaatactgacgttttcagcaatagagtggaaataggctccgggaacctgttcgccatggaaatcaacctgcaagccaatctgtggcggagctttctgtattccaacatcgggctgtatctccccgactccctaaaaatcacccccgacaatattacgctgccagagaacaaaaacacttaccagtacatgaacggtcgcgtgacacctcccgggctcatagacacctacgtcaacgtgggtgcgcgctggtcccccgatgttatggacagcatcaacccctttaaccaccaccgcaacgcggggctgcgttaccgctctatgctgctgggcaacggccgctacgtgcccttccacattcaggtgccccagaaattctttgccattaagaacctgctgctgctccccggttcctacacctacgagtggaacttccgcaaggacgtgaacatgatcttgcagagctcgctgggcaatgacctgcgagtggacggagccagcatccgcttcgacagcatcaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcctccgtcagctggcccggcaacgaccgtctgcttacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtaatgtggaggatacccttctctagcaacttcatgtctatgggatccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 62 - DNA, 2757 bp, Artificial Sequence
  Synthetic oligonucleotide RhAd6666 / RhAd62 Hexon
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggtgctccaaacccatcagagtggaacggaactgacagcaaaaccaatgtcagaggtcaagcaccattcattagtgatgcaataactaaagagggcataaaagttggtacagacacaggaaaccccggacaagcaatttatgctaaaaaagagtatcagcctgaaccccaagtgggggaaacgcaatggaatagcgacgttggagcaacagacaaagcggcaggacgaattttaaagaaaacgacacccatggttccgtgctatgggtcttatgccaaacccacaaacgaagaagggggtcaggctacaaaccagcaggtagatatgcagttttttgctaccggcagttctaatactacaccaaaggttgtgctgtactctgaagacgtgacgattgagacgcccgacacccacttagtatttaagccaattgtaacagcaggaaccacaaatgcagaagctttgttagcgcagcaagctgctcccaatcgaccaaactacattggctttagagataattttattggtcttatgtactacaacagcactggaaacatgggagtgctggctgggcaggcttcgcagttaaacgctgtggttgatttgcaagacagaaacactgagctatcttatcaactaatgctggatgctttgggggatagaagcagatacttttcaatgtggaatcaagcggtggacagttacgatcccgatgtgagaattgtagaaaaccacggagtagaggacgagttaccaaattactgtttcccgttaggcggtatggcagtaactgatacctacacaggtattaaacctgataatggaggcactacattctcaaatgatgacacttttgcaactagaggaatagaaataggttctggaaacatgttcgccatggagattaatctgcaggctaatctgtggcgtagtttcttgtattccaacatcgggctgtaccttccagacaccttgaaaatcactcccgacaacataacgttgccggacaacaaaaacacctaccagtacatgaatggtcgtgtcactccccccgggcttgtggacacctacgtgaacgtgggtgcgcgctggtcccccgacgtcatggacggcattaaccccttcaaccaccaccgcaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcagctaacatgctgtaccccatccccgccaatgccaccagcgtgcccatctctattccttctcggaactgggctgccttcaggggctggagttttactcgcctcaaaaccaaggagactccctcgctgggctccggttttgacccctacttcgtctactccggctccatcccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggttcctaattcaaatgctcagtcactataatataggttaccagggcttctatgtgcccgagaactacaaggaccgcatgtactccttcttccgcaacttccaaccaatgagccggcaggtggtagataccgtgacttatacagactacaaggatgtcaagctcccctaccaacacaacaactcagggttcgtgggctacatgggacccaccatgcgagaggggcaggcctaccccgccaactacccctatcccctgattggggccaccgccgtgcccagcctcacgcagaagaagttcctctgcgaccgggtgatgtggaggatccccttctctagcaactttatgtcgatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 63 - DNA, 2793 bp, Artificial Sequence
  Synthetic oligonucleotide RhAd6668A / RhAd63 Hexon
atggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacc

SEQ ID NO: 64 - DNA, 2805 bp, Artificial Sequence
  Synthetic oligonucleotide RhAd6668B / RhAd64 Hexon
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagctttaagccctactccggaaccgcttacaactccctggctcccaagggtgctcccaaccctgcagaatgggaaaattctgacaacaagctaaaagtgagggctcaggcgccttttgttagctcttacggtgccactgcaattacaaaggatggtattcaagttggagtagtattaacagactcgacacagacgccacagtatgcggataaaacgtatcagcctgagccgcaaattggggaactacagtggaacagcgaagtgggaaacgatgataaagtagcaggcagggttctaaagaaaacaacacctatgtttccttgttacggttcatatgccaagcctaccaacgacaaaggagggcaggcaacacagcccgctgctggtcaagacgctcagaatgcagtagaattacagttctttgctactactagcgccaccaccactccaaaagcggtgttatacgctgaggatgtgtccattgaaacaccagacacccaccttgtgttcaagccaacagtaactgcgggaactacaagttcagaagctttgctgtcccaacaagccgctcccaaccgaccaaactacattgccttcagagataactttatcggccttatgtactacaacagcacgggaaacatgggagtactggccggtcaggcatcccagttaaatgccgtggttgatttgcaagacagaaatactgaactgtcatatcagctaatgttggacgcgctgggagaccgcagtcgctacttctctatgtggaaccaagctgttgacagttacgatccagatgtgagaatagtggaaaatcacggcgtagaagatgaattgccaaattattgctttccattgggcggaacggtagttacggatacctacacgcccatacagccaaatagcaatggaggaggcacatgggttgcaaaagataacgtttttacagatagaggagtggaaataagctcaggtaatatgtttgccatggaaattaacctacaagccaacctctggcgcagctttttgtattccaatattggattgtacctcccagacaccctgaaaataacccccgacaacattacgctgccagagaacaaaaacacctaccagtacatgaacggacgggtaacgccgcccggactcgtggacacctacgttaacgtgggcgcgcgctggtcccccgatgtcatggacagcatcaaccccttcaaccaccaccgcaacgccgggctccgctaccgttccatgctccttggcaacggccgctacgtgcccttccacattcaggtgcctcagaaattctttgccattaagaacctgttactgctccccggttcctacacctacgagtggaacttccgcaaggacgttaatatgatcttgcagagctcgctgggcaatgacctgcgagtggacggggcgagcatccgcttcgacagcattaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcgtcggtcagctggcccggcaacgaccgtctgctgacgcccaacgagttcgaaatcaagcgttcggtggacggtgaagggtacaacgtggcccagagcaacatgaccaaggactggttcttaattcagatgctcagccattacaacatcggctaccagggtttctacgtgcccgagaattacaaagaccgcatgtactccttctttagaaacttccaacctatgagccgtcaagtagtagatactgtggcttataaggactactatcaggacgttaagctcccctaccagcacaacaactcagggttcgtgggctacatgggacctaccatgcgagaggggcaggcctaccccgccaactacccctatcccctgattggggccaccgccgtgcccagcctcacgcagaagaagttcctctgcgaccgggtgatgtggaggatccccttctctagcaactttatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 65 - DNA, 2793 bp, Artificial Sequence
  Synthetic oligonucleotide RhAd6669 / RhAd65 Hexon
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggatcgctcgcagaggctgaccctgcgcttcgtgcccgtagaccgggaggacaccgcgtactcttacaaagtgcgctacacgctggccgtaggggacaaccgggtgctcgacatggccagcacctactttgacatccggggggtgctcgatcgcggtcccagcttcaagccctattcggggaccgcctacaactccctggctcccaagggcgcccccaaccccgctgaatgggcagattctgacagcaaactgaaagtgagggcacaggcaccttttgtcagctcctacggtaataatgcgattacaaaggaaggtattcaggtaggagtaattttaacagactccggacaaacagcacaatatgcggacaaaacgtatcagcctgagccgcagattggagaactacagtggaacagcgaagtaggaaccaatgataaagtagcgggaagggtgcttaagaagacgactccaatgtttccctgttatggttcatacgccaagcctaccaatgcaaaaggagggcaggcgacacagcctgctagtcaagaaactcaaaatccagaattgcagttttttgctgcttccagcaccgtcaacactccaaaagcagtattatacgcagaggacgtgtctattgaagctccagacactcacctggtatttaaaccatcagtaactgaaggaactacaagttcggaagctctactggcacaacaagctgcccctaacaggccaaactatattgcctttcgggacaattttattggcctaatgtattacaatagcactggaaacatgggagtgctggccggacaggcgtcgcaactcaatgcggtggtcgatttgcaagacagaaacacagaactgtcataccagctaatgcttgacgctctgggagatagaagtcgctacttctctatgtggaatcaagccgtggacagttacgatccagatgttagaatagtggaaaatcacggcgtcgaagatgaattgcctaattactgcttccctttgggcggtatggcagtgactgacacctactcgcctataaagcttaatggtgggcaaaacggatgggaagctaataatgacgtttatgccgaaagaggagtggaaataggctcagggaacctgttcgctatggagatcaacctgcaggccaacctgtggcgcagtttcttgtattccaacatcgggctgtacctcccggacactctcaaaatcactcccgacaacatcacgctgccggagaacaagaacacctaccagtacatgaacggtcgcgtgactccccccgggctcgtggacacctacgtcaacgtgggtgcgcgctggtcccccgatgtcatggacagcatcaaccccttcaaccaccaccgcaacgcggggctgcggtaccgttccatgctgctgggcaacggtcgctacgtgcccttccacatccaagtgccccagaaattctttgccatcaagaacctgctgctgctgcccgggtcctacacctacgagtggaacttccgcaaggacgtcaacatgatcctgcagagttccctcggcaacgacctgcgggtggacggggccagcatccgcttcgacagcattaacctctacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggtttgacccctacttcgtctactccggctccatcccctacctggacggcaccttctacctcaaccatactttcaaaaaggtgtcaatcatgttcgactcctcggtcagctggcccggcaacgaccgtctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcaacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctgacgcagaagaagttcctctgcgaccgggtgatgtggaggatccccttctctagcaacttcatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 66 - DNA, 2793 bp, Artificial Sequence
  Synthetic oligonucleotide RhAd6672 / RhAd66 Hexon
atggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggtacaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaacgcagttgtggacttgcaagacagaaacaccgaattgtcataccagcttatgctcgacgcattgggagacagaagtcgatacttttcaatgtggaatcaagctgtcgacagttacgatccagatgttaggataattgaaaaccacggcgttgaagacgagcttccaaattattgttttccactaaatggacagggaatttcaaacacctacaaggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggccggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctccgcaacgacaccaacgaccagtccttcaacgactacctgtgcgcagctaacatgctgtaccccatccccgcgaacgccaccagcgtgcccatctctattccctctcgcaactgggcagcctttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggccaggcaacgaccgcctgctaacgcccaacgagttcgaaattaagcgttcggtagacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctaatcggggccaccgccgtacccagcctgacgcagaaaaagttcctctgtgaccgggtgatgtggaggatccccttctctagcaactttatgtctatgggctccctcaccgacctggggcagaacatgctgtacgccaactccgctcacgccttggacatgacatttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 67 - DNA, 2805 bp, Artificial Sequence
  Synthetic oligonucleotide RhAd6673 / RhAd67 Hexon
atggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagctttaagccctactccggaaccgcttacaactccctggctcccaagggtgctcccaaccctgcagaatgggaaaattctgacaacaagctaaaagtgagggctcaggcgccttttgttagctcttacggtgccactgcaattacaaaggatggtattcaagttggagtagtattaacagactcgacacagacgccacagtatgcggataaaacgtatcagcctgagccgcaaattggggaactacagtggaacagcgaagtgggaaacgatgataaagtagcaggcagggttctaaagaaaacaacacctatgtttccttgttacggttcatatgccaagcctaccaacgacaaaggagggcaggcaacacagcccgctgctggtcaagacgctcagaatgcagtagaattacagttctttgctactactagcgccaccaccactccaaaagcggtgttatacgctgaggatgtgtccattgaaacaccagacacccaccttgtgttcaagccaacagtaactgcgggaactacaagttcagaagctttgctgtcccaacaagccgctcccaaccgaccaaactacattgccttcagagataactttatcggccttatgtactacaacagcacgggaaacatgggagtactggccggtcaggcatcccagttaaatgccgtggttgatttgcaagacagaaatactgaactgtcatatcagctaatgttggacgcgctgggagaccgcagtcgctacttctctatgtggaaccaagctgttgacagttacgatccagatgtgagaatagtggaaaatcacggcgtagaagatgaattgccaaattattgctttccattgggcggaacggtagttacggatacctacacgcccatacagccaaatagcaatggaggaggcacatgggttgcaaaagataacgtttttacagatagaggagtggaaataagctcaggtaatatgtttgccatggaaattaacctacaagccaacctctggcgcagctttttgtattccaatattggattgtacctcccagacaccctgaaaataacccccgacaacattacgctgccagagaacaaaaacacctaccagtacatgaacggacgggtaacgccgcccggactcgtggacacctacgttaacgtgggcgcgcgctggtcccccgatgtcatggacagcatcaaccccttcaaccaccaccgcaacgccgggctccgctaccgttccatgctccttggcaacggccgctacgtgcccttccacattcaggtgcctcagaaattctttgccattaagaacctgttactgctccccggttcctacacctacgagtggaacttccgcaaggacgttaatatgatcttgcagagctcgctgggcaatgacctgcgagtggacggggcgagcatccgcttcgacagcattaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcgtcggtcagctggcccggcaacgaccgtctgctgacgcccaacgagttcgaaatcaagcgttcggtggacggtgaagggtacaacgtggcccagagcaacatgaccaaggactggttcttaattcagatgctcagccattacaacatcggctaccagggtttctacgtgcccgagaattacaaagaccgcatgtactccttctttagaaacttccaacctatgagccgtcaagtagtagatactgtggcttataaggactactatcaggacgttaagctcccctaccagcacaacaactcagggttcgtgggctacatgggtcccaccatgcgagaggggcaggcctacccggccaattatccctatcccctgatcggggccaccgccgtacccagcctgacgcagaaaaagttcctctgcgaccgggtgatgtggaggatccccttctctagcaactttatgtctatgggctccctcaccgacctggggcagaacatgctgtacgccaactccgctcacgctttagatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacc

SEQ ID NO: 68-105 - skipped (38 entries)

SEQ ID NO: 106 - DNA, 1509 bp, Artificial Sequence
  Synthetic oligonucleotide RhAd4282 / RhAd54 Penton
atgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcgcccctgtacgataccaccaaggtgtacctggtggacaacaagtcggcggacatcgcctccctgaattatcaaaacgatcacagcaattttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctgaaaaccagcctcccgagtacgaatggtttgagttcaccattcccgagggcaactattccgagaccatgactatcgatctgatgaacaatgcgatcgtggacaattacctgcaagtggggaggcagaacggggtattggaaagcgatatcggcgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggatcagaaagcgccgccccttccaagagggctttcagatcatgtatgaggacctggaaggaggtaacattccaggtttgctagacgtgccggcgtatgaagagagtgttaaacaggcggaggcgcagggacgagagattcgaggcgacacctttgccacggaacctcacgaactggtaataaaacctctggaacaagacagtaaaaaacggagttacaacattatatccggcactatgaataccttgtaccggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcctaaagtgctctctagtcgcaccttc

SEQ ID NO: 107 - DNA, 1515 bp, Artificial Sequence
  Synthetic oligonucleotide RhAd4300 / RhAd55 Penton
atgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaactcggcagccccgatacgagtggttcgagtttaccattccagagggcaactattccgaaactatgactatcgatctcatgaataacgcgatcgtggacaattacctgcaagtggggagacagaacggggtgctggaaagcgatatcggcgtgaaattcgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttaggaattagaaagcgccgcccattccaagagggctttcaaatcatgtatgaggacctggagggaggtaatatacccgccttactggacgtgtcgaagtacgaagctagcatacaacgcgccaaagcggagggtagagagattcggggagacacctttgcggtagctccccaggacctggaaatagtgcctttaactaaagacagcaaagacagaagctacaatattataaacaacacgacggacaccctgtatcggagctggtttctggcttacaactacggagaccccgagaaaggagtgagatcatggaccatactcaccaccacggacgtgacctgtggctcgcagcaagtgtactggtccctgccggatatgatgcaagacccggtcaccttccgcccctccacccaagtcagcaacttcccggtggtgggcaccgagctgctgcccgtccatgccaagagcttctacaacgagcaggccgtctactcgcaacttattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtggtggctcctaaagttctttctagtcgcaccttc

SEQ ID NO: 108 - DNA, 1509 bp, Artificial Sequence
  Synthetic oligonucleotide RhAd4302 / RhAd56 Penton
atgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattaccaaaacgatcacagcaactttctgactaccgtggtgcagaacaatgacttcaccccgacggaggcgggcacgcagaccattaactttgacgagcgttcccgctggggcggtcagctgaaaaccattctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtgaaatttgataccagaaacttccgactggggtgggatcccgtgaccaagctggtaatgccaggcgtgtacaccaacgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcagcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctaccgctgcgcagcagtatcagtggagttcagcgcgtgaccatcaccgacgccagacgtcgaacctgtccctacgtttacaaagctcttggcgtagtggctcccaaagttctctctagtcgcaccttc

SEQ ID NO: 109 - DNA, 1509 bp, Artificial Sequence
  Synthetic oligonucleotide RhAd4305 / RhAd57 Penton
atgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggattagaaagcgccgccccttccaagagggctttcagatcatgtatgaggacctggagggaggtaatatacccgccctactggacgtgtcaaagtatgaggacagcgtgaagaaggcggaagctcagggacgagaaattcggggcgacacatttgcggtggcaccccaagacctggtgatagagcctttgactaaagacagcaaaaacagaagctacaacattattaccggtactatggacaccaaatatcggagctggtttctggcttacaactacggggatcccgaaaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtctaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttc

SEQ ID NO: 110 - DNA, 1518 bp, Artificial Sequence
  Synthetic oligonucleotide RhAd4308 / RhAd58 Penton
atgagaagagcggtgagagtcacgccggcggtgtatgccgagggtccgcccccctcttacgaaagcgtgatgggatcagcgaacgtgccggccacgctggaggcgccttacgttcctcccagatacctgggacctaccgagggcagaaacagcatccgttactccgagctggcccccctgtacgataccaccaaggtgtacctggtggacaacaagtcggcggacatcgcctccctgaattaccaaaacgaccacagcaacttcctgaccaccgtggtgcagaacaatgacttcaccccgacggaggcgggcacgcagaccattaactttgacgagcgttcccgctggggcggtcagctgaaaaccatcctgcataccaacatgcccaacattaacgagtttatgtccaccaacaagtttagggccaggctgatggtagagaagactaacgctgagactcagcagcctcgatacgagtggtttgagttcaccattcccgagggcaactactccgaaaccatgactatcgatctgatgaataatgccattgtagacaattacctgcaagtcgggaggcagaacggggtgctggagagtgatattggggtaaaatttgataccaggaacttccggctggggtgggatccggtcactaagctggtgatgccaggcgtgtacaccaacgaggcttttcaccccgatatcgtgctgctgcctgggtgcggagtggactttacgcagagccgcttgagtaacctgttaggaatcaggaagcgccgcccctttcaggagggctttcagatcatgtatgaggacttggaaggaggtaacattcccgccctgctggacgtctcgaagtatgaagctagcgtacaacgcgctgaagcggaggggcgagagattcggggagacacctttgccgtggctccccaagacttggttatagagcctttaactaaagacagcaaaaacagaagctacaacattataaccggtaccacggatacccagtaccggagctggtttctggcttacaactacggggatcccgataaaggagtgagatcatggaccatactcaccacgacggacgtgacttgcggctcgcaacaagtgtactggtccctgccggatatgatgcaagacccggttaccttccgcccctccacccaagtcagcaacttcccggtggtgggcaccgagctgctgcccgttcacgccaagagcttttacaacgagcaggccgtgtactcccaactcattcgccagtccaccgcgcttacccacgtgtttaatcgcttccccgagaaccagattctcgtgcgccctcccgctcctactattaccaccgtgagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtagtggctcctaaagtgctctctagtcgcaccttc

SEQ ID NO: 111 - DNA, 1509 bp, Artificial Sequence
  Synthetic oligonucleotide RhAd4309 / RhAd59 Penton
atgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctgaaaaccagcctcccgagtacgaatggtttgagttcaccattcccgagggcaactattccgagaccatgactatcgatctgatgaacaatgcgatcgtggacaattacctgcaagtggggaggcagaacggggtattggaaagcgatatcggtgtgaaatttgacaccagaaacttccgactggggtgggatcccgtgaccaagctggtgatgccaggcgtgtacaccaacgaggcttttcaccccgacatcgtgctgctgccggggtgcggcgtggatttcactcagagccgcttgagtaacctgttagggatcaggaagcgccgtcccttccaggagggctttcagatcatgtatgaggacctggagggaggcaacattccagggctgttagacgttcctgcttatgaggacagcgtgaaaaaggcggaagcccaaggacgggagatacggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcctaaagtgctctctagtcgcaccttc

SEQ ID NO: 112 - DNA, 1515 bp, Artificial Sequence; identical to SEQ ID NO: 107
  Synthetic oligonucleotide RhAd4310B / RhAd60 Penton

SEQ ID NO: 113 - DNA, 1515 bp, Artificial Sequence
  Synthetic oligonucleotide RhAd6665 / RhAd61 Penton
atgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaacccaacagccccgatacgagtggtttgagtttactattccagagggcaactactccgagaccatgactatcgatctaatgaataacgcgatcgtggacaattacctgcaagtggggaggcagaacggggtattggaaagcgatatcggtgtgaaatttgataccagaaacttccgactggggtgggatcccgtgaccaagctggtgatgccaggcgtgtacaccaacgaggcttttcaccccgacatcgtgctgcttccggggtgtggtgtggactttactcagagccgcttgagtaacctgttaggaatcaggaagcgccgtcccttccaggagggctttcaaatcatgtatgaggacctggagggaggtaacattccaggcttgctagacgtgccggcgtatgaacaaagcttacagcaagcccaagaggaggggcgagtaactcgcggagacacctttgctacggctccccatgagttggtgattcagcctttaacgaaagacagtaaaaacagaagttacaaccttatacccaactctacggatacactgtaccggagctggttcctggcttacaactacggcgatcccgagaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtccaccgcgcttacccacgtgttcaatcgctttcccgagaaccagattttggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagctcttggcgtagtggctcctaaagtgctctctagtcgcaccttc

SEQ ID NO: 114 - DNA, 1509 bp, Artificial Sequence; identical to SEQ ID NO: 109
  Synthetic oligonucleotide RhAd6666 / RhAd62 Penton

SEQ ID NO: 115 - DNA, 1515 bp, Artificial Sequence; identical to SEQ ID NO: 107
  Synthetic oligonucleotide RhAd6668A / RhAd63 Penton

SEQ ID NO: 116 - DNA, 1515 bp, Artificial Sequence; identical to SEQ ID NO: 113
  Synthetic oligonucleotide RhAd6668B / RhAd64 Penton

SEQ ID NO: 117 - DNA, 1509 bp, Artificial Sequence
  Synthetic oligonucleotide RhAd6669 / RhAd65 Penton
atgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagcacggggtgctggagagcgatatcggcgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgcttgagtaacctgttaggaatcaggaagcgccgtcccttccaggagggctttcaaatcatgtatgaggatctggagggaggcaacattcccgccctactggacgtgtcaaagtatgaggacagcgtgaagaaggcggaagctcagggacgagaaattcggggcgacacatttgcggtggcaccccaagacctggtgatagagcctttgactaaagacagcaaaaacagaagctacaacattattaccggtactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttc

SEQ ID NO: 118 - DNA, 1509 bp, Artificial Sequence
  Synthetic oligonucleotide RhAd6672 / RhAd66 Penton
atgagaagagcggtgagagtcacgccggcggcgtatgagggcccgcccccttcttacgaaagcgtgatgggatcagcgaacgtaccggccacgctggaggcgccttacgttcctcccagatacctgggacctaccgagggcagaaacagcatccgttactccgagctcgcgcccctgtacgataccaccaaggtgtacctggtggacaacaagtcggcggacatcgcctccctgaattaccaaaacgaccacagcaacttcctgactaccgtggtgcagaacaatgacttcaccccgacggaggcgggcacgcagaccattaattttgacgagcgttcccgctggggcggtcagctgaaaaccatcctgcacaccaacatgcccaacatcaacgagttcatgtccaccaacaagttcagggctaagctgatggtagaaaaaattagcggacaacctcccaaatatgaatggttcgagttcaccattcccgagggtaactactccgagaccatgactatcgatctgatgaataacgcgattgtggacaattacctgcaagtggggaggcagaacggggtattggaaagcgatatcggtgtgaaatttgataccagaaacttccgactggggtgggatcccgtgaccaagctggtgatgccaggcgtgtacaccaatgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcggcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttc

SEQ ID NO: 119 - DNA, 1515 bp, Artificial Sequence; identical to SEQ ID NO: 113
  Synthetic oligonucleotide RhAd6673 / RhAd67 Penton

SEQ ID NO: 120 - protein, 363 aa, Artificial Sequence
  Synthetic polypeptide RhAd4282 / RhAd54 Short Fiber
MKRTRVDEDFNPVYPYDTTTTPAVPFISPPFVNSDGLQENPPGVLSLRIAKPLYFDMERKLALSLGRGLTITAAGQLESTQSVQTNPPLIITNNNTLTLRHSPPLNLTDNSLVLGYSSPLRVTDNKLTFNFTSPLRYENENLTFKYTEPLKLINNSLAIDINSSKGLSSVGGSLAVNLSSDLKFDSNGSIAFGIQTLWTAPTSTGNCTVYSEGDSLLSLCLTKCGAHVLGSVSLTGLTGTITQMTDISVTIQFTFDNNGKLLSSPLINNAFSIRQNDSTASNPTYNALAFMPNSTIYARGGGGEPRNNYYVQTYLRGNVQKPIILTVTYNSAATGYSLSFKWTALAREKFATPTTSFCYITEQ

SEQ ID NO: 121 - protein, 293 aa, Artificial Sequence
  Synthetic polypeptide RhAd4300 / RhAd55 Short Fiber-1
MYLLITTHDFHLSQMKRTRVDEDFNPVYPYDAEQSSSVPFVTPPFTSSNGLTESPSGVLTLNYSQPLTTINGKLTLNVDGGLNINNDKKLQVRTNENEGVTLQNNAVSVKIGNDLRFDSRGQITLNPVSLWTTPSESANCTLYNSSANFFLCLTRNDAHVVGTVNLTGINGKFSSMTENSVIVQLAFDENGTLQSSPLAQNVWGIRQTPNSPNAVNLLTFMPSSLVYPREGGGKPKNNLYFNTFLRGNLSRPITLTLTLNSLPTGYTLTFKWGTYLNEPFSVPTTCFCYVAEQ

SEQ ID NO: 122 - protein, 292 aa, Artificial Sequence
  Synthetic polypeptide RhAd4300 / RhAd55 Short Fiber-2
MKRARVDESFNPVYPYDSTSTPAIPFVTPPFVSNDGLQENPPGILSLQIAKPLFFNTQRKIALSLGRGLAITSAGELENTQRIQSTPPLLLNSNTLSMNYSSPLTVLDNKLALNYLSPLRVVNDSLTFNFTSPLHVADGNLTFSYTSPLQVTNNSLALNYSAPLRLLNNSLTFTYANPFKIANSSLSLKLDYPSALRLNNNGSLQVIAGWGLGIAGNNDLYVKRQAPLAVYESGSNAGTLYLRLGPNSALRTVNDNLTLNTGQGLQITNNTLSVKLGNGLRFNNTGAIELAQ

SEQ ID NO: 123 - protein, 363 aa, Artificial Sequence
  Synthetic polypeptide RhAd4302 / RhAd56 Short Fiber
MKRTRVDEDFNPVYPYDTTTTPAVPFISPPFVNSDGLQENPPGVLSLRIAKPLYFDMERKLALSLGRGLTITAAGQLESTQSVQTNPPLIITNNNTLTLRHSPPLNLTDNSLVLGYSSPLRVTDNKLTFNFTSPLRYENENLTFNYTEPLKLINNSLAIDINSSKGLSSVGGSLAVNLSSDLKFDSNGSIAFGIQTLWTAPTSTGNCTVYSEGDSLLSLCLTKCGAHVLGSVSLTGLTGTITQMTDISVTIQFTFDNNGKLLSSPLINNAFSIRQNDSTASNPTYNALAFMPNSTIYARGGGGEPRNNYYVQTYLRGNVQKPIILTVTYNSAATGYSLSFKWTALAREKFATPTTSFCYITEQ

SEQ ID NO: 124 - protein, 293 aa, Artificial Sequence; identical to SEQ ID NO: 121
  Synthetic polypeptide RhAd4305 / RhAd57 Short Fiber-1

SEQ ID NO: 125 - protein, 292 aa, Artificial Sequence; identical to SEQ ID NO: 122
  Synthetic polypeptide RhAd4305 / RhAd57 Short Fiber-2

SEQ ID NO: 126 - protein, 348 aa, Artificial Sequence
  Synthetic polypeptide RhAd4308 / RhAd58 Short Fiber
MKRTRVDEDFNPVYPYDTTSTPAVPFISPPFVNSDGLQENPPGILSLRIDRPLYFNTQRQLALSLGNGLAITAGGELESTLSVRPNPPLVINGNSLSLRYSDPLRVVNDSLTFNFTSPLRFESGSLTFHYASPLKLMNDSLALDVEPSKGLSTDGNKLAVKLSSDLKFDNNGAIAFGIQSLWTAPTTTPNCMTYAENDSLLSLCLTKCGAHVLGSVSLTGFTGDLLNMKQTTVSIEFRFDNNGILTTSPLVNSSSWGIRQNNGIYPNPVYNALAFMPNSTVYSRGGGGEPRNNYYTQTYLRGNTQIPITLTVTYNSANTGYSLTFKWTALTNQKFAAPTASFCYISEQ

SEQ ID NO: 127 - protein, 293 aa, Artificial Sequence; identical to SEQ ID NO: 121
  Synthetic polypeptide RhAd4309 / RhAd59 Short Fiber-1

SEQ ID NO: 128 - protein, 292 aa, Artificial Sequence
  Synthetic polypeptide RhAd4309 / RhAd59 Short Fiber-2
MKRARVDESFNPVYPYDSTSTPAIPFVTPPFVSNDGLQENPPGILSLQIAKPLFFNTQRKIALSLGRGLAITSAGELENTQRIQSTPPLLLNSNTLSMNYSSPLTVLDNKLALNYLSPLRVVNDSLTFNFTSPLHVADGNLTFSYTSPLHVTNNSLALNYSAPLRLLNNSLTFTYANPFKIANSSLSLKLDYPSALRLNNNGSLQVIAGWGLGIAGNNDLYVKRQAPLAVYESGSNAGTLYLRLGPNSALRTVNDNLTLNTGQGLQITNNTLSVKLGNGLRFNNTGAIELAQ

SEQ ID NO: 129 - protein, 259 aa, Artificial Sequence
  Synthetic polypeptide RhAd4310B / RhAd60 Short Fiber-1
MSTSLPLPTIFIFSEMKRTRVDEDFNPVYPYDTTSTPAIPFISPPFVNSDGFQESPPGILSLRLNKPLSFTNHAVSLNVGSGLTINSTGFLEATQQISTANPLLLQNNTLSLISSAPLYVNGSALALRLNSPFVVHNNGLAINLAEPLYVTNNSLNLRLASPFYVNNNSLNLRLPNPSGLSIDGSGLKVKAGYGLRLHANNDLYVYTDFPLDKYDNGAKQGQLYLRTGKGLQLSNNDLTVKLGAGLKFDNNGAITLAST

SEQ ID NO: 130 - protein, 359 aa, Artificial Sequence
  Synthetic polypeptide RhAd4310B / RhAd60 Short Fiber-2
MKRARIDEDYNPVYPYNTSTPPFIAPPFVDNDGFQENPQGVLSLRISKPLYFDMNKRLSLSLGQGLSTTSAGELESAQNVRANPPLSINSNTVSLRYSSPLNLTENGLVLGYSDPLRVVGGALTFNYTSPLRYENDSLTFNYTSPLKLMNNSLAIEVNSSKGVTSKNGAIAVQLSPDLKFDSNGSIAFGIQTLWTFPTTTSNCTVFTSNDSLLSLCLTKCGAHVLGSVSLTGMAGALLNMTQTSVTIQFTFDNTGSLTSSPLINNAWGIRQNDSASPNPTFNALTFMPNSTVYSRGGSGEPRNNYYTQTYLRGNIRKPIVLTVTYNSANTGYSLSFKWDAIATEKFATPTSSFCYISEQ

SEQ ID NO: 131 - protein, 312 aa, Artificial Sequence
  Synthetic polypeptide RhAd6665 / RhAd61 Short Fiber-1
MRWWAANFLQTLKEILLSTSLLFPTIFIFSEMKRTRVDEDFNPVYPYNTEPTPSAPFVTPPFVSSNGLMESPSGVLSIRYTQPITVVNNSLSLKTGNGLSVSSDGKLQIAINTNKGLSNEDNKIAVKVGPELYFDADGAITMNSQTLWTNPNETANCSVFQSLDSLLTLCLTKNGAHVLGSVSLTGLSGPLLKMTTTSVTVQLIFDSNGVLTTSQLNTNSWGMRANTNLNAPVTNALPFMPNSTIYARGNAGEPRSNYYVQTYLRGNLNKQITLSISFNASSSGYSLTFKWSAIATEKFATPTSSFCYIAEQ

SEQ ID NO: 132 - protein, 291 aa, Artificial Sequence
  Synthetic polypeptide RhAd6665 / RhAd61 Short Fiber-2
MKRTRIEDDFNPVYPYDSVSAPAVPFVSPPFVNSDGLKESPPGVLSLQIAKPLLFDAQRKVTLSLGRGLAVNSAGQLESTQILQTNPPLLLSNNMLSLDCAFPLSVANNQLSLKYTDPLRLVNDSLTFNFTSPLHLANGNLTFSYTTPLNIINNSLALNYSPPLRLVNSNLTMGYADPFQVANSNLSLKIANPSGLRIRNGNLQIAAGYGLQIAGNNDLYVRRETPLDVYTSGAKEGILYLRLGPNSGLQVLSDNLSLKTGQGLQILSNTLSVKLGRGLRFDSSGAIELST

SEQ ID NO: 133 - protein, 364 aa, Artificial Sequence
  Synthetic polypeptide RhAd6666 / RhAd62 Short Fiber
MKRTRVDEDFNPVYPYDSTSTPAVPFISPPFVNSDGLQENPPGVLSLRIAKPLYFDMERKLALSLGRGLAITSTGQLESTQSVQTTPPLVVNNSNTLVLRYSSPLGLSGDNLILNCSDPLRVINNSLTFSYLSPLRFEGGSLTFNYTSPLKLLNSSLAIGINSNKGLGNDSDELSVKLTSDLKFNNDGKIAFGIQSLCTTPTAASNCTVFTNGDSLLCLCLTKCGAHVLGSVSLTGMQGTITAMTQNYISIQFLFDHNGALTSSPLLNNNTWGIRQSDTSSANPAYNALAFMPNSTVYVRGQSGEPRNNYYTQTYLRGNVKKPIILTVTYNSAASGYSLTSKWDAVVTEKFATPTSSFCYITEQ

SEQ ID NO: 134 - protein, 259 aa, Artificial Sequence; identical to SEQ ID NO: 129
  Synthetic polypeptide RhAd6668A / RhAd63 Short Fiber-1

SEQ ID NO: 135 - protein, 359 aa, Artificial Sequence; identical to SEQ ID NO: 130
  Synthetic polypeptide RhAd6668A / RhAd63 Short Fiber-2

SEQ ID NO: 136 - protein, 259 aa, Artificial Sequence; identical to SEQ ID NO: 129
  Synthetic polypeptide RhAd6668B / RhAd64 Short Fiber-1

SEQ ID NO: 137 - protein, 359 aa, Artificial Sequence; identical to SEQ ID NO: 130
  Synthetic polypeptide RhAd6668B / RhAd64 Short Fiber-2

SEQ ID NO: 138 - protein, 259 aa, Artificial Sequence; identical to SEQ ID NO: 129
  Synthetic polypeptide RhAd6669 / RhAd65 Short Fiber-1

SEQ ID NO: 139 - protein, 359 aa, Artificial Sequence
  Synthetic polypeptide RhAd6669 / RhAd65 Short Fiber-2
MKRARIDEDYNPVYPYNTSTPPFIAPPFVDNDGFQENPQGVLSLRISKPLYFDMNKRLSLSLGQGLSTTSAGELESAQNVRANPPLSINSNTVSLRYSSPLNLTENGLVLGYSDPLRVVGGALTFNYTSPLRYENDSLTFNYTSPLKLMNNSLAIEVNSSKGVTSKNGAIAVQLSPDLKFDSNGSIAFGIQTLWTFPTTTSNCTVFTSNDSLLSLCLTKCGAHVLGSVSLTGMAGALLNMTQTSVTIEFTFDNTGSLTSSPLINNAWGIRQNDSASPNPTFNALTFMPNSTVYSRGGSGEPRNNYYTQTYLRGNIRKPIVLTVTYNSANTGYSLSFKWDAIATEKFATPTSSFCYISEQ

SEQ ID NO: 140 - protein, 259 aa, Artificial Sequence
  Synthetic polypeptide RhAd6672 / RhAd66 Short Fiber-1
MSTSLPLPTIFIFSEMKRTRVDEDFNPVYPYDTTSTPAIPFISPPFVNSDGFQESPPGILSLRLNKPLSFTNHAVSLNVGSGLTINSTGFLEATQQISAANPLLLQNNTLSLISSAPLYVNGSALALRLNSPFVVHNNGLAINLAEPLYVTNNSLNLRLASPFYVNNNSLNLRLPNPSGLSIDGSGLKVKAGYGLRLHANNDLYVYTDFPLDKYDNGAKQGQLYLRTGKGLQLSNNDLTVKLGAGLKFDNNGAITLAST

SEQ ID NO: 141 - protein, 359 aa, Artificial Sequence
  Synthetic polypeptide RhAd6672 / RhAd66 Short Fiber-2
MKRARIDEDYNPVYPYNTSTPPFIAPPFVDNDGFQENPQGVLSLRISKPLYFDINKRLSLSLGQGLSTTSAGELESAQNVRANPPLSINSNTVSLRYSSPLNLTENGLVLGYSDPLRVVGGALTFNYTSPLRYENDSLTFNYTSPLKLMNNSLAIEVNSSKGVTSKNGAIAVQLSPDLKFDSNGSIAFGIQTLWTFPTTTSNCTVFTSNDSLLSLCLTKCGAHVLGSVSLTGMAGALLNMTQTSVTIQFTFDNTGSLTSSPLINNAWGIRQNDSASPNPTFNALTFMPNSTVYSRGGSGEPRNNYYTQTYLRGNIRKPIVLTVTYNSANTGYSLSFKWDAIATEKFATPTSSFCYISEQ

SEQ ID NO: 142 - protein, 224 aa, Artificial Sequence
  Synthetic polypeptide RhAd6673 / RhAd67 Short Fiber-1
MYLLITTHDFHLSQMKRTRVDEDFNPVYPYDAEQSSSVPFVTPPFTSSNGLTESPSGVLTLNYSQPLTTINGKLTLNVDGGLNINNDKKLQVRTNENEGVTLQNNAVSVKIGNDLRFDSRGQITLNPVSLWTTPSESANCTLYNSSANFFLCLTRNDAHVVGTVNLTGINGKFSSMTENSVIVQLAFDENGTLQSSPLAQNVWAYVKLLTLQTLLICLHLCPAA

SEQ ID NO: 143 - protein, 292 aa, Artificial Sequence; identical to SEQ ID NO: 128
  Synthetic polypeptide RhAd6673 / RhAd67 Short Fiber-2

SEQ ID NO: 144 - protein, 560 aa, Artificial Sequence
  Synthetic polypeptide RhAd4282 / RhAd54 Long Fiber
MKRARVDEDFNPVYPYDPPHAPVMPFITPPFTSSDGLQEKPLGVLSLNYRDPITTQNGSLTIKLGNGLTLDNQGQLTSTAGEVEPPLTNANNKLALVYSEPLAVKRNSLTLSHTAPLVIADNSLALQVSEPIFINDKDKLALQTAAPLVTNAGTLRLQSAAPLGIADQTLKLLFTNPLYLQNNFLTLAIERPLAITNTGKLALQLSPPLQTADTGLTLQTNVPLTVSNGTLGLAIKRPLIVQDNNLFLDFRAPLRLFNSDPVLGLNFYTPLAVRDEALTVNTGRGLTVSYDGLILNLGKDLRFDNNTVSVALSAALPLQYTDQLRLNVGAGLRYNPVSKKLDVNPNQNKGLTWENDYLIVKLGNGLGFDGDGNIAVSPQVTSPDTLWTTADPSPNCSIYTDLDAKMWLSLVKQGGMVHGSVALKALKGTLLSPTESAIVIILHFDNYGVRILNYPTLGTQGTLGNNATWGYRQGESADTNVLNALAFMPSSKRYPRGRGSEVQNQTVGYTCIQGDLSMPVPYQIQYNYGPTGYSFKFIWRTVSRQPFDIPCCFFSYITEE

SEQ ID NO: 145 - protein, 555 aa, Artificial Sequence
  Synthetic polypeptide RhAd4300 / RhAd55 Long Fiber
MKRARVDEDFNPVYPYDPPYAPIMPFITPPFTSSDGLQEKPFGVLSINYKDPITTQNGSLTLKVGNGLSINNQGQLTSTQTTVTPPLTNESDTLGLAYSDPLTVKNNSLTLSHSAPFAVSNHSLSLKTTTPFFINQQNELALSTDAPLQVTAGSLRLQSAAPLGIAEQTLRLLFSNPLFLQDNFLTLAIERPLAITSSGNLTVQLNPPFQSTSTGLALSLSNPLTISNGTLAMSIKRPFIIDDNKLYMDFRPPLRLFNSEPQLGVHFNPPITVQQGGLALNTGDGLQVYLNKLTLNIGRDLQYENGSLVVKLTPAPPLQYTTQLQLNMGAGLHLGATKQLTLDVDTNRGLTWNNNKLAVNLGDGLQFNSYGQIIPTVKKDTLWTTADPSPNCSIYKDLDAKLWLSLVKSGGMVHGSIALQALKDTLLSPTDSFITIILYFDENGVRAPYPTFDNEGTLAKDATWGYRQGPSADTNVTNALEFMPSSARYPRGKHEQAQNQTFGYTCLQGNFSWPIPFRVQYNYVRTGFSFKFTWQVVNRQKFDIPCCSFSYITEQ

SEQ ID NO: 146 - protein, 560 aa, Artificial Sequence
  Synthetic polypeptide RhAd4302 / RhAd56 Long Fiber
MKRARVDEDFNPVYPYDPPHAPVMPFITPPFTSSDGLQEKPLGVLSLNYRDPITTQNGSLTVKLGNGLTLDNQGQLTSTAGEVEPPLTNANNKLALVYSDPLAVKRNSLTLSHTAPLVIADNSLALQVSEPIFINDKDKLALQTAAPLVTNAGTLRLQSAAPLGIADQTLKLLFTNPLYLQNNFLTLAIERPLAITNSGKLALQLSPPLQTADTGLTLQTNVPLTVSNGTLGLAIKRPLIVQDNNLFLDFRAPLRLFNSDPVLGLNFYTPLAVRDEALTVNTGRGLTVSYDGLILNLGKDLRFDNNTVSVALSAALPLQYTDQLRLNVGAGLRYNPVSKKLDVNPNQNKGLTWENDYLIVKLGNGLGFDGNGNIAVSPQVTSPDTLWTTADPSPNCSIYTDLDAKMWLSLVKQGGVVHGSVALKALKGTLLSPTESAIVIILHFDNYGVRILNYPTLGTQGTLGNNATWGYRQGESADTNVLNALAFMPSSKRYPRGRGSEVQNQTVGYTCIQGDLSMPVPYQIQYNYGPTGYSFKFIWRTVSRQPFDIPCCFFSYITEE

SEQ ID NO: 147 - protein, 555 aa, Artificial Sequence
  Synthetic polypeptide RhAd4305 / RhAd57 Long Fiber
MKRARVDEDFNPVYPYDPPYAPIMPFITPPFTSSDGLQEKPFGVLSINYKDPITTQNGSLTLKVGNGLSINNQGQLTSTQTTVTPPLTNESDTLGLAYSDPLTVKNNSLTLSHSAPFAVSNHSLSLKTTTPFFINQQNELALSTDAPLQVTAGSLRLQSAAPLGIAEQTLRLLFSNPLFLQDNFLTLAIERPLAITSSGNLTVQLNPPFQSTSTGLALSLSNPLTISNGTLAMSIKRPFIIDDNKLYMDFRPPLRLFDSEPQLGVHFNPPITVQQGGLALNTGDGLQVYLNKLTLNIGRDLQYENGSLVVKLTPAPPLQYTTQLQLNMGAGLHLGATKQLTLDVDTNRGLTWNNNKLAVNLGDGLQFNSYGQIIPTVKKDTLWTTADPSPNCSIYKDLDAKLWLSLVKSGGMVHGSIALQALKDTLLSPTDSFITIILYFDENGVRAPYPTFDNEGTLAKDATWGYRQGPSADTNVTNALEFMPSSARYPRGKHEQAQNQTFGYTCLQGNFSWPIPFRVQYNYVRTGFSFKFTWQVVNRQKFDIPCCSFSYITEQ

SEQ ID NO: 148 - protein, 559 aa, Artificial Sequence
  Synthetic polypeptide RhAd4308 / RhAd58 Long Fiber
MKRVRIDEDFNPVYPYDPPYAPVMPFITPPFTSSDGLQEKPLGVLSLNYKDPITTQNGSLTLKIGNGLTLDNQGQLTSTAGEVEPPLTNANNKLALAYSEPLAVKSNRITLSHTAPLVVADDSLALQVSEPIFIDDDDKLALQTAAPLVTNAGTLRLQSAAPLGLVENTLRLLFSKPLYLQNDFLALAIERPLAIAAAGTLALQLTPPLKTNDDGLTLSTVEPLTVKNGNLGLQISRPLVVQNSSLSLAITPPLRLFNSDPVLGLGFTFPLAVTNNLLSLNMGDGVKLTYNKLTANLGRDLQFENGAIAVTLTAELPLQYTNKLQLNIGAGLRYNGASRKLDVNINQNKGLTWDNDAVIPKLGSGLQFDPNGNIAVIPETVKPQTLWTTADPSPNCSVYQNLDARLWLALVKSGDMVHGSIALKALKGTLLNPTASYISIVIYFYSNGVRRTNYPTFDNEGTLANSATWGYREGQSANTNVTNATEFMPSSTRYPVNKGDNIQNQSFSYTCIKGDFAMPVPFRVTYNHALEGYSLKFTWRVVANQAFDIPCCSFSYITE

SEQ ID NO: 149 - protein, 555 aa, Artificial Sequence; identical to SEQ ID NO: 145
  Synthetic polypeptide RhAd4309 / RhAd59 Long Fiber

SEQ ID NO: 150 - protein, 593 aa, Artificial Sequence
  Synthetic polypeptide RhAd4310B / RhAd60 Long Fiber
MGCYCNRKICHSYIFILLHFRTIKSCYTPSRFFQMKRARVDEDFNPVYPYDSPNAPIMPFITPPFTSSDGLQEKPLGVLSLNYKDPVTTQNGSLTLKLGSGLNINDQGQLTSTAGEVEPPLTNNNNKLALAYSQPLAVENNRLIVSYNAPLAVTGNSLGLQVSEPIFINDNDKLALQTAAPLKTNAGTLRLQSAAPLGLAEETLKLLFSKPLYLQGDFLSLGIERPLAIAAAGTLALQLTPPLTTNDSGLTISTADPVTVSNGNLGLRISRPLVVQNNSLSLALTPPLRLFNSEPVLGLGFTFPITVVDNLLSLNIGNGLTLLYNKLTANLGRDLQFQNGAIAVSLTTEPPLQYTTKLQLNVGAGLRYNGASRKLDVDINQQKGLTWENNAVVPKLGQGLYFDPQGNIAMSPTNVKPDTLWTTADPSPNCSVYTDLDAKLWLSLVKCGGMVQGSIALQAQKGTLMSVTDPSVTIILHFNDNGVRINYPTLDNQGTLGRDSTWGYRQGQSANTNVTNAVEFMPNSSRYPRGRGEQAQNQTVGYTCLQGNLSMPIFFQVQYNYVTTGYSFKFTWQAVQRQKFDIPCCSFSYITEE

SEQ ID NO: 151 - protein, 560 aa, Artificial Sequence
  Synthetic polypeptide RhAd6665 / RhAd61 Long Fiber
MKRARIEEDFNPVYPYDPPYAPIMPFITPPFTSSDGLQEKPFGVLSLNYKNPITTQNGSLTLKLGNGLNINNQGELTSTAGAVQPPLTNADNKLTLAYSEPLTVQNKRLTLSHSAPLAVADNSLSLQVTDPIFINADNKLALQTDAPLNTTTGVLRLKSAAPLGLVEQTLNLLFAKPLYLQGDFLALAIERPLAVTADGSLALALDPPLKTSNTGLGLLTAAPLTVTNGNLNLNVKRPFVIQDNSLYMDFRAPLRLFNSEPQLGVNFTSPLTVRADALTLDTGNGLQVLFNKLTLNLGRDLEYDNGAIAVRLNPAAPLQYTNQLQLNLGAGLRLGVSKKLTVDVDENKGLTWNGNQLVASLGTGLAFDNYGRISVVSTAAGDDTLWTTADPSPNCTVYEQLDARLWLSLVKCGGMVQGSVALKAEKGRLLNPTASFISIVMYFNRYGVWRTDYPTIGDDQGIIANSATWGYRRGESADTNVTNALKFMPSSRRYPINQGNNIQNQMITYTCIQGDVSMPVPLKITFNHAFEGYSFKFTWRVVANQRFDIPCCSFSYITEE

SEQ ID NO: 152 - protein, 559 aa, Artificial Sequence
  Synthetic polypeptide RhAd6666 / RhAd62 Long Fiber
MKRARVDEDFNPVYPYDSPNAPIMPFITPPFTSSDGLQEKPLGVLSLNYKDPVTTQNGSLTLKLGSGLNINDQGQLTSTAGEVEPPLTNNNNKLALAYSQPLAVENNRLIVSYNAPLAVTGNSLGLQVSEPIFINDNDKLALQTAAPLKTNAGTLRLQSAAPLGLAEETLKLLFSKPLYLQGDFLSLGIERPLAIAAAGTLALQLTPPLTTNDSGLTISTADPVTVSNGNLGLRISRPLVVQNNSLSLALTPPLRLFNSEPVLGLGFTFPITVVDNLLSLNIGNGLTLLYNKLTANLGRDLQFQNGAIAVSLTTEPPLQYTTKLQLNVGAGLRYNGASRKLDVDINQQKGLTWENNAVVPKLGQGLYFDPQGNIAMSPTNVKPDTLWTTADPSPNCSVYTDLDAKLWLSLVKCGGMVQGSIALQAQKGTLMSVTDPSVTIILHFNDNGVRINYPTLDNQGTLGRDSTWGYRQGQSANTNVTNAVEFMPNSSRYPRGRGEQAQNQTVGYTCLQGNLSMPIFFQVQYNYVTTGYSFKFTWQAVQRQKFDIPCCSFSYITEE

SEQ ID NO: 153 - protein, 529 aa, Artificial Sequence
  Synthetic polypeptide RhAd6668A / RhAd63 Long Fiber
MGCYCNRKICHSYIFILLHFRTIKSCYTPSRFFQMKRARVDEDFNPVYPYDSPNAPIMPFITPPFTSSDGLQEKPLGVLSLNYKDPVTTQNGSLTLKLGSGLNINDQGQLTSTAGEVEPPLTNNNNKLALAYSQPLAVENNRLIVSYNAPLAVTGNSLGLQVSEPIFINDNDKLALQTAAPLKTNAGTLRLQSAAPLGLAEETLKLLFSKPLYLQGDFLSLGIERPLAIAAAGTLALQLTPPLTTNDSGLTISTADPVTVSNGNLGLRISRPLVVQNNSLSLALTPPLRLFNSEPVLGLGFTFPITVVDNLLSLNIGNGLTLLYNKLTANLGRDLQFQNGAIAVSLTTEPPLQYTTKLQLNVGAGLRYNGASRKLDVDINQQKGLTWENNAVVPKLGQGLYFDPQGNIAMSPTNVKPDTLWTTADPSPNCSVYTDLDAKLWLSLVKCGGMVQGSIALQAQKGTLMSVTDPSVTIILHFNDNGVRINYPTLDNQGTLGRDYANFFPSPVQLCNHWIFLQIHLASCTKAKV

SEQ ID NO: 154 - protein, 593 aa, Artificial Sequence
  Synthetic polypeptide RhAd6668B / RhAd64 Long Fiber
MGCYCNRKICHAYIFILLHFRTIKSCYTPSRFFQMKRARVDEDFNPVYPYDSPNAPIMPFITPPFTSSDGLQEKPLGVLSLNYKDPVTTQNGSLTLKLGSGLNINDQGQLTSTAGEVEPPLTNNNNKLALAYSQPLAVENNRLIVSYNAPLAVTGNSLGLQVSEPIFINDNDKLALQTAAPLKTNAGTLRLQSAAPLGLAEETLKLLFSKPLYLQGDFLSLGIERPLAIAAAGTLALQLTPPLTTNDSGLTISTADPVTVSNGNLGLRISRPLVVQNNSLSLALTPPLRLFNSEPVLGLGFTFPITVVDNLLSLNIGNGLTLLYNKLTANLGRDLQFQNGAIAVSLTTEPPLQYTTKLQLNVGAGLRYNGASRKLDVDINQQKGLTWENNAVVPKLGQGLYFDPQGNIAMSPTNVKPDTLWTTADPSPNCSVYTDLDAKLWLSLVKCGGMVQGSIALQAQKGTLMSVTDPSVTIILHFNDNGVRINYPTLDNQGTLGRDSTWGYRQGQSANTNVTNAVEFMPNSSRYPRGRGEQAQNQTVGYTCLQGNLSMPIFFQVQYNYVTTGYSFKFTWQAVQRQKFDIPCCSFSYITEE

SEQ ID NO: 155 - protein, 593 aa, Artificial Sequence
  Synthetic polypeptide RhAd6669 / RhAd65 Long Fiber
MGCYCNRKICHSYIFILLHFRTIKSCYTPSRFFQMKRARVDEDFNPVYPYDSPNAPIMPFITPPFTSSDGLQEKPLGVLSLNYKDPVTTQNGSLTLKLGSGLNINDQGQLTSTAGEVEPPLTNNNNKLALAYSQPLAVENNRLIVSYNAPLAVTGNSLGLQVSEPIFINDNDKLALQTAAPLKTNAGTLRLQSAAPLGLAEETLKLLFSKPLYLQGDFLSLGIERPLAIAAAGTLALQLTPPLTTNDSGLTISTADPVTVSNGNLGLRISRPLVVQNNSLSLALTPPLRLFNSEPVLGLGFTFPITVVDNLLSLNIGNGLTLLYNKLTANLGRDLQFQNGAIAVSLTTEPPLQYTTKLQLNVGAGLRYNGASRKLDVDINQQKGLTWENNAVVPKLGQGLYFDPQGNIAMSPTNVKPDTLWTTADPSPNCSVYTDLDAKLWLSLVKCGGMVQGSIALQAQKGTLMSVTEPSVTIILHFNDNGVRINYPTLDNQGTLGRDSTWGYRQGQSANTNVTNAVEFMPNSSRYPRGRGEQAQNQTVGYTCLQGNLSMPIFFQVQYNYVTTGYSFKFTWQAVQRQKFDIPCCSFSYITEE

SEQ ID NO: 156 - protein, 593 aa, Artificial Sequence; identical to SEQ ID NO: 150
  Synthetic polypeptide RhAd6672 / RhAd66 Long Fiber

SEQ ID NO: 157 - protein, 555 aa, Artificial Sequence; identical to SEQ ID NO: 145
  Synthetic polypeptide RhAd6673 / RhAd67 Long Fiber

SEQ ID NO: 158 - protein, 931 aa, Artificial Sequence
  Synthetic polypeptide RhAd4282 / RhAd54 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPAEWTNSDSKVKVRAQAPFVSSYGATAITKEGIQVGVTLTDSGSTPQYADKTYQPEPQIGELQWNSDVGTDDKIAGRVLKKTTPMFPCYGSYARPTNEKGGQATPSASQDVQNPELQFFASTNVANTPKAVLYAEDVSIEAPDTHLVFKPTVTEGITSSEALLTQQAAPNRPNYIAFRDNFIGLMYYNSTGNMGVLAGQASQLNAVVDLQDRNTELSYQLMLDALGDRSRYFSMWNQAVDSYDPDVRIIENHGVEDELPNYCFPLGGMAVTDTYSPIKVNGGGNGWEANNGVFTERGVEIGSGNMFAMEINLQANLWRSFLYSNIGLYLPDSLKITPDNITLPENKTTYQYMNGRVTPPGLVDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLVQMLSHYNIGYQGFYVPENYKDRMYSFFRNFQPMSRQIVDSTAYTNYQDVKLPYQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 159 - protein, 932 aa, Artificial Sequence
  Synthetic polypeptide RhAd4300 / RhAd55 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPAEWADSDSKLKVRAQAPFVSSYGNNAITKEGIQVGVILTDSGQTAQYADKTYQPEPQIGELQWNSEVGTNDKVAGRVLKKTTPMFPCYGSYAKPTNAKGGQATQPASQETQNPELQFFAASSTTVNTPKAVLYAEDVSIEAPDTHLVFKPSVTEGTTSSEALLTQQAAPNRPNYIAFRDNFIGLMYYNSTGNMGVLAGQASQLNAVVDLQDRNTELSYQLMLDALGDRSRYFSMWNQAVDSYDPDVRIVENHGVEDELPNYCFPLGGMAVTDTYSPIKLNGGQNGWEANNDVYAERGVEIGSGNLFAMEINLQANLWRSFLYSNIGLYLPDSLKITPDNITLPENKNTYQYMNGRVTPPGLIDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQIVDSTAYTNYQDVKLPYQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 160 - protein, 931 aa, Artificial Sequence
  Synthetic polypeptide RhAd4302 / RhAd56 Hexon
MATPSMMPQWSYMHIAGQDASEYLSPGLVQFARATDTYFSLGNKFRNPTVAPTHDVTTDRSQRLTLRFVPVDREDTAYSYKVRFTLAVGDNRVLDMASTYFDIRGMLDRGPSFKPYSGTAYNSLAPKGAPNPSQWITNGGTAKTNSFAQASYIGMGANLTTNGIQVAVDTNNANAAVYANKIYQPEPQVGTSRWNINPTQNAAGRILKPTTPMQPCYGSYAYPTNENGGQVKITDGSTDPTGANSVSMEFFTTTADNQNQAKVVLYSEDVNLEAPDTHLVFKPDVADNAKAAETLLGQQSAPNRPNYIGFRDNFIGLMYYNSTGNMGVLAGQASQLNAVVDLQDRNTELSYQLMLDALGDRSRYFSMWNQAVDSYDPDVRIIENHGVEDELPNYCFPLNGQGISNTYRGLSVQNGQNTWQANNNAAENNEISIGNIFAMEINLAANLWRSFLYSNVALYLPDSYKYTPDNIELPTNQNSYGYINGRVTAPNAIDTYVNIGARWSPDPMDNVNPFNHHRNAGLRYRSMLLGNGRYVPFHIQVPQKFFAIKNLLLLPGSYTYEWNFRKDVNMILQSTLGNDLRVDGASVRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDSVNYANYKEVKMPFQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 161 - protein, 918 aa, Artificial Sequence
  Synthetic polypeptide RhAd4305 / RhAd57 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPSEWEGSDNKTHVRGQAPFISDEITKEGIKVGTDTGNPGQAIYAKKAYQPEPQVGETQWNSDVGTNDKAAGRILKKTTPMVPCYGSYAKPTNEEGGQATNQQVDLQFFSTGSSNTTPKVVLYSEDVSLETPDTHLVFKPTVTAGVTNAEALLAQQAAPNRPNYIAFRDNFIGLMYYNSTGNMGVLAGQASQLNAVVDLQDRNTELSYQLMLDALGDRSRYFSMWNQAVDSYDPDVRIVENHGVEDELPNYCFPLGGMAVTDTYSGIKPSDNGGTFQADNTVADRVEIGSGNMFAMEINLQANLWRGFLYSNIGLYLPDTLKLTPDNITLPENKNTYQYMNGRVTPPGLVDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQIVDSTAYTNYQDVKLPYQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 162 - protein, 931 aa, Artificial Sequence
  Synthetic polypeptide RhAd4308 / RhAd58 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPAEWTNTDSKVKVRAQAPFVSSYGATAITKEGVQVGVVLTDSGSTPQYADKTYQPEPQIGEQQWNSDVGTNDKIAGRVLKKTTPMFPCYGSYARPTNEKGGQATPSASQDVQNPELQFFASTNVANTPKAVLYAEDVAIEAPDTHLVFKPTVTEGITSSEALLTQQAAPNRPNYIAFRDNFIGLMYYNSTGNMGVLAGQASQLNAVVDLQDRNTELSYQLMLDALGDRSRYFSMWNQAVDSYDPDVRIIENHGVEDELPNYCFPLGGMAVTDTYSPIKVNTAGNGWEANNDVFTDRGVEIGSGNMFAMEINLQANLWRSFLYSNIGLYLPDSLKITPDNITLPENKNTYQYMNGRVTPPGLVDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQIVDSTSYTNYQDVKLPYQHNNSGFVGYMGPTMREGQAYPANYPYPLIGATAVPSLTQKKFLCDRVMWRIPFSSNFMSMGALTDLGQNMLYANSAHALDMTFELDPMDEPTLLYVLFEVFDVVRIHQPHRGVIEAVYLRTPFSAGNATT

SEQ ID NO: 163 - protein, 919 aa, Artificial Sequence
  Synthetic polypeptide RhAd4309 / RhAd59 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPSEWNGTDSKTNVRGQAPFISDAITKEGIKVGTDTGNHGQAIYAKKEYQPEPQVGETQWNSDVGATDKAAGRILKKTTPMVPCYGSYAKPTNEEGGQATNQQVDMQFFATGSSNTTPKVVLYSEDVTIETPDTHLVFKPIVTAGTTNAEALLAQQAAPNRPNYIGFRDNFIGLMYYNSTGNMGVLAGQASQLNAVVDLQDRNTELSYQLMLDALGDRSRYFSMWNQAVDSYDPDVRIVENHGVEDELPNYCFPLGGMAVTDTYTGIKPDNGGTTFSNDDTFATRGIEIGSGNMFAMEINLQANLWRSFLYSNIGLYLPDTLKITPDNITLPDNKNTYQYMNGRVTPPGLVDTYVNVGARWSPDVMDGINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDTVTYTDYKDVKLPYQHNNSGFVGYMGPTMREGQAYPANYPYPLIGETAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 164 - protein, 921 aa, Artificial Sequence
  Synthetic polypeptide RhAd4310B / RhAd60 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPSEWTDTSDNKLKAYAQAPYQSQGLTKDGIQVGLVVTESGQTPQYANKVYQPEPQIGENQWNLEQEDKAAGRVLKKDTPMFPCYGSYARPTNEQGGQAKNQEVDLQFFATPGDTQNTAKVVLYAENVNLETPDTHLVFKPDDDSTSSKLLLGQQAAPNRPNYIGFRDNFIGLMYYNSTGNMGVLAGQASQLNAVVDLQDRNTELSYQLMLDALGDRSRYFSMWNQAVDSYDPDVRIIENHGVEDELPNYCFPLGGMVVTDNYNSVTPQNGGSGNTWQADNTTFSQRGAQIGSGNMFALEINLQANLWRGFLYSNIGLYLPDSLKITPDNITLPENKNTYQYMNGRVTPPGLIDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDTVTYTDYKDVKLPYQHNNSGFVGYMGPTMREGQAYPANYPYPLIGETAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 165 - protein, 937 aa, Artificial Sequence
  Synthetic polypeptide RhAd6665 / RhAd61 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPAEWEDTNDSNKLKVRGQAPYVSTFGAATALTKDGIQVGVTVSESARTPQYADKSYQPEPQIGETEWNSEVGNDDKLAGRVLKKSTPMFPCYGSYAKPTNEKGGQAIQPAGSSGDTNPAVELQFFATTSATTTPKAVLYAEDVAIEAPDTHLVFKPTVTAGTTSSEALLTQQAAPNRPNYIAFRDNFIGLMYYNSTGNMGVLAGQASQLNAVVDLQDRNTELSYQLMLDALGDRSRYFSMWNQAVDSYDPDVRIVENHGVEDELPNYCFPLGGMVVTDTYTPIKPNGSGSVTWTANTDVFSNRVEIGSGNLFAMEINLQANLWRSFLYSNIGLYLPDSLKITPDNITLPENKNTYQYMNGRVTPPGLIDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQIVDSTAYTNYQDVKLPYQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 166 - protein, 919 aa, Artificial Sequence
  Synthetic polypeptide RhAd6666 / RhAd62 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPSEWNGTDSKTNVRGQAPFISDAITKEGIKVGTDTGNPGQAIYAKKEYQPEPQVGETQWNSDVGATDKAAGRILKKTTPMVPCYGSYAKPTNEEGGQATNQQVDMQFFATGSSNTTPKVVLYSEDVTIETPDTHLVFKPIVTAGTTNAEALLAQQAAPNRPNYIGFRDNFIGLMYYNSTGNMGVLAGQASQLNAVVDLQDRNTELSYQLMLDALGDRSRYFSMWNQAVDSYDPDVRIVENHGVEDELPNYCFPLGGMAVTDTYTGIKPDNGGTTFSNDDTFATRGIEIGSGNMFAMEINLQANLWRSFLYSNIGLYLPDTLKITPDNITLPDNKNTYQYMNGRVTPPGLVDTYVNVGARWSPDVMDGINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDTVTYTDYKDVKLPYQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 167 - protein, 931 aa, Artificial Sequence
  Synthetic polypeptide RhAd6668A / RhAd63 Hexon
MATPSMMPQWSYMHIAGQDASEYLSPGLVQFARATDTYFSLGNKFRNPTVAPTHDVTTDRSQRLTLRFVPVDREDTAYSYKVRFTLAVGDNRVLDMASTYFDIRGMLDRGPSFKPYSGTAYNSLAPKGAPNPSQWITNGGTAKTNSFAQASYIGMGANLTTNGIQVAVDTNNANAAVYANKIYQPEPQVGTSQWNINPTQNAAGRILKPTTPMQPCYGSYAYPTNENGGQVKITDGSTDPTGANSVSMEFFTTTADNQNQAKVVLYSEDVNLEAPDTHLVFKPDVADNAKAAETLLGQQSAPNRPNYIGFRDNFIGLMYYNSTGNMGVLAGQASQLNAVVDLQDRNTELSYQLMLDALGDRSRYFSMWNQAVDSYDPDVRIIENHGVEDELPNYCFPLNGQGISNTYRGLSVQNGQNTWQANNNAAENNEISIGNIFAMEINLAANLWRSFLYSNVALYLPDSYKYTPDNIELPTNQNSYGYINGRVTAPNAIDTYVNIGARWSPDPMDNVNPFNHHRNAGLRYRSMLLGNGRYVPFHIQVPQKFFAIKNLLLLPGSYTYEWNFRKDVNMILQSTLGNDLRVDGASVRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDSVNYANYKEVKMPFQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 168 - protein, 935 aa, Artificial Sequence
  Synthetic polypeptide RhAd6668B / RhAd64 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPAEWENSDNKLKVRAQAPFVSSYGATAITKDGIQVGVVLTDSTQTPQYADKTYQPEPQIGELQWNSEVGNDDKVAGRVLKKTTPMFPCYGSYAKPTNDKGGQATQPAAGQDAQNAVELQFFATTSATTTPKAVLYAEDVSIETPDTHLVFKPTVTAGTTSSEALLSQQAAPNRPNYIAFRDNFIGLMYYNSTGNMGVLAGQASQLNAVVDLQDRNTELSYQLMLDALGDRSRYFSMWNQAVDSYDPDVRIVENHGVEDELPNYCFPLGGTVVTDTYTPIQPNSNGGGTWVAKDNVFTDRGVEISSGNMFAMEINLQANLWRSFLYSNIGLYLPDTLKITPDNITLPENKNTYQYMNGRVTPPGLVDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDTVAYKDYYQDVKLPYQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 169 - protein, 931 aa, Artificial Sequence
  Synthetic polypeptide RhAd6669 / RhAd65 Hexon
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPAEWADSDSKLKVRAQAPFVSSYGNNAITKEGIQVGVILTDSGQTAQYADKTYQPEPQIGELQWNSEVGTNDKVAGRVLKKTTPMFPCYGSYAKPTNAKGGQATQPASQETQNPELQFFAASSTVNTPKAVLYAEDVSIEAPDTHLVFKPSVTEGTTSSEALLAQQAAPNRPNYIAFRDNFIGLMYYNSTGNMGVLAGQASQLNAVVDLQDRNTELSYQLMLDALGDRSRYFSMWNQAVDSYDPDVRIVENHGVEDELPNYCFPLGGMAVTDTYSPIKLNGGQNGWEANNDVYAERGVEIGSGNLFAMEINLQANLWRSFLYSNIGLYLPDTLKITPDNITLPENKNTYQYMNGRVTPPGLVDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQIVDSTAYTNYQDVKLPYQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 170 - protein, 931 aa, Artificial Sequence
  Synthetic polypeptide RhAd6672 / RhAd66 Hexon
MATPSMMPQWSYMHIAGQDASEYLSPGLVQFARATDTYFSLGNKFRNPTVAPTHDVTTDRSQRLTLRFVPVDREDTAYSYKVRFTLAVGDNRVLDMASTYFDIRGMLDRGPSFKPYSGTAYNSLAPKGAPNPSQWITNGGTAKTNSFAQASYIGMGANLTTNGIQVAVDTNNANAAVYANKIYQPEPQVGTSQWNINPTQNAAGRILKPTTPMQPCYGSYAYPTNENGGQVKITDGTTDPTGANSVSMEFFTTTADNQNQAKVVLYSEDVNLEAPDTHLVFKPDVADNAKAAETLLGQQSAPNRPNYIGFRDNFIGLMYYNSTGNMGVLAGQASQLNAVVDLQDRNTELSYQLMLDALGDRSRYFSMWNQAVDSYDPDVRIIENHGVEDELPNYCFPLNGQGISNTYKGLSVQNGQNTWQANNNAAENNEISIGNIFAMEINLAANLWRSFLYSNVALYLPDSYKYTPDNIELPTNQNSYGYINGRVTAPNAIDTYVNIGARWSPDPMDNVNPFNHHRNAGLRYRSMLLGNGRYVPFHIQVPQKFFAIKNLLLLPGSYTYEWNFRKDVNMILQSTLGNDLRVDGASVRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDSVNYANYKEVKMPFQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 171 - protein, 935 aa, Artificial Sequence; identical to SEQ ID NO: 168
  Synthetic polypeptide RhAd6673 / RhAd67 Hexon

SEQ ID NO: 172 - protein, 168 aa, Artificial Sequence
  Synthetic polypeptide RhAd4282 / RhAd54 Short Fiber Knob
TLWTAPTSTGNCTVYSEGDSLLSLCLTKCGAHVLGSVSLTGLTGTITQMTDISVTIQFTFDNNGKLLSSPLINNAFSIRQNDSTASNPTYNALAFMPNSTIYARGGGGEPRNNYYVQTYLRGNVQKPIILTVTYNSAATGYSLSFKWTALAREKFATPTTSFCYITEQ

SEQ ID NO: 173 - protein, 165 aa, Artificial Sequence
  Synthetic polypeptide RhAd4300 / RhAd55 Short Fiber-1 Knob
SLWTTPSESANCTLYNSSANFFLCLTRNDAHVVGTVNLTGINGKFSSMTENSVIVQLAFDENGTLQSSPLAQNVWGIRQTPNSPNAVNLLTFMPSSLVYPREGGGKPKNNLYFNTFLRGNLSRPITLTLTLNSLPTGYTLTFKWGTYLNEPFSVPTTCFCYVAEQ

SEQ ID NO: 174 - skipped

SEQ ID NO: 175 - protein, 168 aa, Artificial Sequence; identical to SEQ ID NO: 172
  Synthetic polypeptide RhAd4302 / RhAd56 Short Fiber Knob

SEQ ID NO: 176 - protein, 165 aa, Artificial Sequence; identical to SEQ ID NO: 173
  Synthetic polypeptide RhAd4305 / RhAd57 Short Fiber-1 Knob

SEQ ID NO: 177 - skipped

SEQ ID NO: 178 - protein, 169 aa, Artificial Sequence
  Synthetic polypeptide RhAd4308 / RhAd58 Short Fiber Knob
SLWTAPTTTPNCMTYAENDSLLSLCLTKCGAHVLGSVSLTGFTGDLLNMKQTTVSIEFRFDNNGILTTSPLVNSSSWGIRQNNGIYPNPVYNALAFMPNSTVYSRGGGGEPRNNYYTQTYLRGNTQIPITLTVTYNSANTGYSLTFKWTALTNQKFAAPTASFCYISEQ

SEQ ID NO: 179 - protein, 165 aa, Artificial Sequence; identical to SEQ ID NO: 173
  Synthetic polypeptide RhAd4309 / RhAd59 Short Fiber-1 Knob

SEQ ID NO: 180-181 - skipped (2 entries)

SEQ ID NO: 182 - protein, 168 aa, Artificial Sequence
  Synthetic polypeptide RhAd4310B / RhAd60 Short Fiber-2 Knob
TLWTFPTTTSNCTVFTSNDSLLSLCLTKCGAHVLGSVSLTGMAGALLNMTQTSVTIQFTFDNTGSLTSSPLINNAWGIRQNDSASPNPTFNALTFMPNSTVYSRGGSGEPRNNYYTQTYLRGNIRKPIVLTVTYNSANTGYSLSFKWDAIATEKFATPTSSFCYISEQ

SEQ ID NO: 183 - protein, 167 aa, Artificial Sequence
  Synthetic polypeptide RhAd6665 / RhAd61 Short Fiber-1 Knob
TLWTNPNETANCSVFQSLDSLLTLCLTKNGAHVLGSVSLTGLSGPLLKMTTTSVTVQLIFDSNGVLTTSQLNTNSWGMRANTNLNAPVTNALPFMPNSTIYARGNAGEPRSNYYVQTYLRGNLNKQITLSISFNASSSGYSLTFKWSAIATEKFATPTSSFCYIAEQ

SEQ ID NO: 184 - skipped

SEQ ID NO: 185 - protein, 168 aa, Artificial Sequence
  Synthetic polypeptide RhAd6666 / RhAd62 Short Fiber Knob
LCTTPTAASNCTVFTNGDSLLCLCLTKCGAHVLGSVSLTGMQGTITAMTQNYISIQFLFDHNGALTSSPLLNNNTWGIRQSDTSSANPAYNALAFMPNSTVYVRGQSGEPRNNYYTQTYLRGNVKKPIILTVTYNSAASGYSLTSKWDAVVTEKFATPTSSFCYITEQ

SEQ ID NO: 186 - skipped

SEQ ID NO: 187 - protein, 168 aa, Artificial Sequence; identical to SEQ ID NO: 182
  Synthetic polypeptide RhAd6668A / RhAd63 Short Fiber-2 Knob

SEQ ID NO: 188 - skipped

SEQ ID NO: 189 - protein, 168 aa, Artificial Sequence; identical to SEQ ID NO: 182
  Synthetic polypeptide RhAd6668B / RhAd64 Short Fiber-2 Knob

SEQ ID NO: 190 - skipped

SEQ ID NO: 191 - protein, 168 aa, Artificial Sequence
  Synthetic polypeptide RhAd6669 / RhAd65 Short Fiber-2 Knob
TLWTFPTTTSNCTVFTSNDSLLSLCLTKCGAHVLGSVSLTGMAGALLNMTQTSVTIEFTFDNTGSLTSSPLINNAWGIRQNDSASPNPTFNALTFMPNSTVYSRGGSGEPRNNYYTQTYLRGNIRKPIVLTVTYNSANTGYSLSFKWDAIATEKFATPTSSFCYISEQ

SEQ ID NO: 192 - skipped

SEQ ID NO: 193 - protein, 168 aa, Artificial Sequence; identical to SEQ ID NO: 182
  Synthetic polypeptide RhAd6672 / RhAd66 Short Fiber-2 Knob

SEQ ID NO: 194 - skipped

SEQ ID NO: 195 - protein, 168 aa, Artificial Sequence; identical to SEQ ID NO: 182
  Synthetic polypeptide RhAd6673 / RhAd67 Short Fiber-2 Knob

SEQ ID NO: 196 - protein, 176 aa, Artificial Sequence
  Synthetic polypeptide RhAd4282 / RhAd54 Long Fiber Knob
TLWTTADPSPNCSIYTDLDAKMWLSLVKQGGMVHGSVALKALKGTLLSPTESAIVIILHFDNYGVRILNYPTLGTQGTLGNNATWGYRQGESADTNVLNALAFMPSSKRYPRGRGSEVQNQTVGYTCIQGDLSMPVPYQIQYNYGPTGYSFKFIWRTVSRQPFDIPCCFFSYITEE

SEQ ID NO: 197 - protein, 175 aa, Artificial Sequence
  Synthetic polypeptide RhAd4300 / RhAd55 Long Fiber Knob
TLWTTADPSPNCSIYKDLDAKLWLSLVKSGGMVHGSIALQALKDTLLSPTDSFITIILYFDENGVRAPYPTFDNEGTLAKDATWGYRQGPSADTNVTNALEFMPSSARYPRGKHEQAQNQTFGYTCLQGNFSWPIPFRVQYNYVRTGFSFKFTWQVVNRQKFDIPCCSFSYITEQ

SEQ ID NO: 198 - protein, 176 aa, Artificial Sequence
  Synthetic polypeptide RhAd4302 / RhAd56 Long Fiber Knob
TLWTTADPSPNCSIYTDLDAKMWLSLVKQGGVVHGSVALKALKGTLLSPTESAIVIILHFDNYGVRILNYPTLGTQGTLGNNATWGYRQGESADTNVLNALAFMPSSKRYPRGRGSEVQNQTVGYTCIQGDLSMPVPYQIQYNYGPTGYSFKFIWRTVSRQPFDIPCCFFSYITEE

SEQ ID NO: 199 - protein, 175 aa, Artificial Sequence; identical to SEQ ID NO: 197
  Synthetic polypeptide RhAd4305 / RhAd57 Long Fiber Knob

SEQ ID NO: 200 - protein, 175 aa, Artificial Sequence
  Synthetic polypeptide RhAd4308 / RhAd58 Long Fiber Knob
TLWTTADPSPNCSVYQNLDARLWLALVKSGDMVHGSIALKALKGTLLNPTASYISIVIYFYSNGVRRTNYPTFDNEGTLANSATWGYREGQSANTNVTNATEFMPSSTRYPVNKGDNIQNQSFSYTCIKGDFAMPVPFRVTYNHALEGYSLKFTWRVVANQAFDIPCCSFSYITE

SEQ ID NO: 201 - protein, 175 aa, Artificial Sequence; identical to SEQ ID NO: 197
  Synthetic polypeptide RhAd4309 / RhAd59 Long Fiber Knob

SEQ ID NO: 202 - protein, 175 aa, Artificial Sequence
  Synthetic polypeptide RhAd4310B / RhAd60 Long Fiber Knob
TLWTTADPSPNCSVYTDLDAKLWLSLVKCGGMVQGSIALQAQKGTLMSVTDPSVTIILHFNDNGVRINYPTLDNQGTLGRDSTWGYRQGQSANTNVTNAVEFMPNSSRYPRGRGEQAQNQTVGYTCLQGNLSMPIFFQVQYNYVTTGYSFKFTWQAVQRQKFDIPCCSFSYITEE

SEQ ID NO: 203 - protein, 177 aa, Artificial Sequence
  Synthetic polypeptide RhAd6665 / RhAd61 Long Fiber Knob
TLWTTADPSPNCTVYEQLDARLWLSLVKCGGMVQGSVALKAEKGRLLNPTASFISIVMYFNRYGVWRTDYPTIGDDQGIIANSATWGYRRGESADTNVTNALKFMPSSRRYPINQGNNIQNQMITYTCIQGDVSMPVPLKITFNHAFEGYSFKFTWRVVANQRFDIPCCSFSYITEE

SEQ ID NO: 204 - protein, 175 aa, Artificial Sequence; identical to SEQ ID NO: 202
  Synthetic polypeptide RhAd6666 / RhAd62 Long Fiber Knob

SEQ ID NO: 205 - protein, 111 aa, Artificial Sequence
  Synthetic polypeptide RhAd6668A / RhAd63 Long Fiber Knob
TLWTTADPSPNCSVYTDLDAKLWLSLVKCGGMVQGSIALQAQKGTLMSVTDPSVTIILHFNDNGVRINYPTLDNQGTLGRDYANFFPSPVQLCNHWIFLQIHLASCTKAKV

SEQ ID NO: 206 - protein, 175 aa, Artificial Sequence; identical to SEQ ID NO: 202
  Synthetic polypeptide RhAd6668B / RhAd64 Long Fiber Knob

SEQ ID NO: 207 - protein, 175 aa, Artificial Sequence
  Synthetic polypeptide RhAd6669 / RhAd65 Long Fiber Knob
TLWTTADPSPNCSVYTDLDAKLWLSLVKCGGMVQGSIALQAQKGTLMSVTEPSVTIILHFNDNGVRINYPTLDNQGTLGRDSTWGYRQGQSANTNVTNAVEFMPNSSRYPRGRGEQAQNQTVGYTCLQGNLSMPIFFQVQYNYVTTGYSFKFTWQAVQRQKFDIPCCSFSYITEE

SEQ ID NO: 208 - protein, 175 aa, Artificial Sequence; identical to SEQ ID NO: 202
  Synthetic polypeptide RhAd6672 / RhAd66 Long Fiber Knob

SEQ ID NO: 209 - protein, 175 aa, Artificial Sequence; identical to SEQ ID NO: 202
  Synthetic polypeptide RhAd6673 / RhAd67 Long Fiber Knob

SEQ ID NO: 210 - protein, 503 aa, Artificial Sequence
  Synthetic polypeptide RhAd4282 / RhAd54 Penton
MRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRARLMVKKAENQPPEYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPGLLDVPAYEESVKQAEAQGREIRGDTFATEPHELVIKPLEQDSKKRSYNIISGTMNTLYRSWFLAYNYGDPEKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 211 - protein, 505 aa, Artificial Sequence
  Synthetic polypeptide RhAd4300 / RhAd55 Penton
MRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRAKLMVEKSNAETRQPRYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPALLDVSKYEASIQRAKAEGREIRGDTFAVAPQDLEIVPLTKDSKDRSYNIINNTTDTLYRSWFLAYNYGDPEKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 212 - protein, 503 aa, Artificial Sequence
  Synthetic polypeptide RhAd4302 / RhAd56 Penton
MRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRARLMVKKVENQPPEYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPGLLDVPAYEDSVKKAEAQGREIRGDTFATEPHALVIKPLTEDSKKRSYNIITGTMDTEYRSWFLAYNYGDPEKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 213 - protein, 503 aa, Artificial Sequence
  Synthetic polypeptide RhAd4305 / RhAd57 Penton
MRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRARLMVKKVENQPPEYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPALLDVSKYEDSVKKAEAQGREIRGDTFAVAPQDLVIEPLTKDSKNRSYNIITGTMDTKYRSWFLAYNYGDPEKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 214 - protein, 506 aa, Artificial Sequence
  Synthetic polypeptide RhAd4308 / RhAd58 Penton
MRRAVRVTPAVYAEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRARLMVEKTNAETQQPRYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPALLDVSKYEASVQRAEAEGREIRGDTFAVAPQDLVIEPLTKDSKNRSYNIITGTTDTQYRSWFLAYNYGDPDKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 215 - protein, 503 aa, Artificial Sequence
  Synthetic polypeptide RhAd4309 / RhAd59 Penton
MRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRARLMVKKAENQPPEYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPGLLDVPAYEDSVKKAEAQGREIRGDTFATEPHALVIKPLTEDSKKRSYNIITGTMDTEYRSWFLAYNYGDPEKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 216 - protein, 505 aa, Artificial Sequence; identical to SEQ ID NO: 211
  Synthetic polypeptide RhAd4310B / RhAd60 Penton

SEQ ID NO: 217 - protein, 505 aa, Artificial Sequence
  Synthetic polypeptide RhAd6665 / RhAd61 Penton
MRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRAKLMVEKSNAETQQPRYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPGLLDVPAYEQSLQQAQEEGRVTRGDTFATAPHELVIQPLTKDSKNRSYNLIPNSTDTLYRSWFLAYNYGDPEKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 218 - protein, 503 aa, Artificial Sequence; identical to SEQ ID NO: 213
  Synthetic polypeptide RhAd6666 / RhAd62 Penton

SEQ ID NO: 219 - protein, 505 aa, Artificial Sequence; identical to SEQ ID NO: 211
  Synthetic polypeptide RhAd6668A / RhAd63 Penton

SEQ ID NO: 220 - protein, 505 aa, Artificial Sequence; identical to SEQ ID NO: 217
  Synthetic polypeptide RhAd6668B / RhAd64 Penton

SEQ ID NO: 221 - protein, 503 aa, Artificial Sequence
  Synthetic polypeptide RhAd6669 / RhAd65 Penton
MRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRARLMVKKVENQPPEYEWFEFTIPEGNYSETMTIDLMNNAIVDNYLQVGRQHGVLESDIGVKFDTRNFRLGWDPVTKLVMPGVYTNEAFHPDIVLLPGCGVDFTQSRLSNLLGIRKRRPFQEGFQIMYEDLEGGNIPALLDVSKYEDSVKKAEAQGREIRGDTFAVAPQDLVIEPLTKDSKNRSYNIITGTMDTEYRSWFLAYNYGDPEKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 222 - protein, 503 aa, Artificial Sequence
  Synthetic polypeptide RhAd6672 / RhAd66 Penton
MRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRAKLMVEKISGQPPKYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPGLLDVPAYEDSVKKAEAQGREIRGDTFATEPHALVIKPLTEDSKKRSYNIITGTMDTEYRSWFLAYNYGDPEKGVRSWTILTTTDVTCGSQQVYWSLPDMMQDPVTFRPSTQVGNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 223 - protein, 505 aa, Artificial Sequence; identical to SEQ ID NO: 217
  Synthetic polypeptide RhAd6673 / RhAd67 Penton

SEQ ID NO: 224 - DNA, 6079 bp, Artificial Sequence
  Synthetic oligonucleotide RhAdApt54.Empty
catcatcaataatataccttattctggaaacgtgccaatatgataatgagcggggaggagcgaggcggggccggggtgacgtgcggtgacgcggggtgacgcggggtggcgcgagggcggggcgggtgtgcggaggcgcttagtttttacgtatgcggaaggaggttttataccggaagttgggtaatttgggcgtatacttgtaagttttgtgtagtttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctcctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatcctgacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 225 - DNA, 37654 bp, Artificial Sequence
  Synthetic oligonucleotide pWe/RhAd54.pIX-rITR.dE3
taatgacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatttcggcgctcaagttgtcagtttctacaaacgaggaggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggatttaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggctccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggccgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcaccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggcagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccagctcctcctcttccaggggcacaggttcctccggcagctctgcgacggggacggggcggcgacgtcgtctgaccggcaggcggtccacgaagcgttcgatcatttcgccgcgccggcgacgcatggtctcggtgacggcgcgtccgttttcgcgaggtcgcagttcgaaaacgccgccgcgcagagcgcccccgtgcagggagggtaagtggttagggccgtcgggcagggacacggcgctgacgatgcattttatcaattgctgcgtaggcactccgcgcagggatctgagaacgtcgaggtcgacgggatccgagaacttctctaggaaagcgtctatccaatcgcaatcgcaaggtaagctgaggacggtgggtcgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggctgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtgaggaggcggttctcggtacaggggccagccaacggtggcgggggcgccgggggacaggtcgtccagcatgaggcgatggtagtggtagatgtagcgggagagccaggtgatgccggccgaggtggtcgcggccctggtaaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgtcgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgggagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcaacacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacacacgagaaagtcctgactatcgtgaacgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaatttgcaaggcatgtggggcgttaaggccccggtgggcgatcgagccaccatctccagtctgctgacccccaacactcgcctgctgctgctcttgatcgcgccgttcaccaacagtagcactatcagccgtgactcgtacctgggtcatctcatcactttgtaccgcgaggccatcggtcaggctcagatcgacgagcacacatatcaggagatcactaacgtgagccgggccctgggtcaggaagataccggcagcctggaagccacgttgaactttttgctaaccaaccggaggcaaaaaataccctcccagtttacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccggccgttcattaaccgtctgatggactacttccatcgcgcggccgccatgaacggggagtacttcaccaatgccatcctgaatccgcattggatgcccccgtccggcttctacaccggcgagtttgacctgcccgaagccgacgacggctttctttgggacgacgtgtccgacagcattttcacgccgggcaatcgccgattccagaagaaggagggcggagacgagctccccctctccagcgtggaggcggcctctaggggagagagtccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttccagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcgcccctgtacgataccaccaaggtgtacctggtggacaacaagtcggcggacatcgcctccctgaattatcaaaacgatcacagcaattttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctgaaaaccagcctcccgagtacgaatggtttgagttcaccattcccgagggcaactattccgagaccatgactatcgatctgatgaacaatgcgatcgtggacaattacctgcaagtggggaggcagaacggggtattggaaagcgatatcggcgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggatcagaaagcgccgccccttccaagagggctttcagatcatgtatgaggacctggaaggaggtaacattccaggtttgctagacgtgccggcgtatgaagagagtgttaaacaggcggaggcgcagggacgagagattcgaggcgacacctttgccacggaacctcacgaactggtaataaaacctctggaacaagacagtaaaaaacggagttacaacattatatccggcactatgaataccttgtaccggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctcgggccgaacggcggtagacgataccatagatgccgtgattgccgacgcccgccggtacaaccccggaccggtcgctagcgccgcctccaccgtggattccgtgatcgacagcgtggtagctggcgctcgggcctatgctcgccgcaagaggcggctgcatcggagacgtcgccccaccgccgccatgctggcagccagggccgtgctgaggcgggcccggagggtaggcagaagggctatgcgccgcgctgccgccaacgccgccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgctttagacagcggcaaccccacgcccagcctcaaacctgtgacgctgcagcaggtgctccccgtgagcgccagcacggacagcaagaggggaataaaaagagaaatggaagatctgcagcccaccatccagctcatggtccctaaacggcagaggctggaagaggtcctggagaaaatgaaagtggaccccagcatagagccggacgtcaaagtcaggccgatcaaagaagtggcccctggtctcggggtgcagacggtggatatccagatccccgtcacgtcagcttcgaccgccgtggaagccatggaaacgcaaacggaaacccctgccgcgatcggtaccagggaagtggcgttgcaaaccgacccctggtacgaatacgccgcccctcggcgtcagaggcgacccgctcgttacggccccgccaacgccatcatgccagaatatgcgctgcatccgtctatcctgcccacccccggctaccggggagtgacgtatcgcccgtcaggaacccgccgccgaacccgtcgccgccgccgctcccgtcgtgctctggcccccgtgtcggtgcgccgcgtaacacgccggggaaagacagttaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaatggggtggtgaccggcatccacggcgcggtagatctcgccaaccaagcggtgcagaaagagattgacaggcgtttggaaagctcgcgggtgccgccgcagagaggggatgaggtggaggtcgaggaagtagaagtagaggaaaagctgcccccgctggagaaagttcccggtgcgcctccgagaccgcagaagcgacccaggccagaactagaagaaactctggtgacggagagcaaggagcctccctcgtacgagcaagccttgaaagagggcgcctctccaccctacccaatgacaaaaccgatcgcgcctatggctcggccggtgtacgggaaggactacaagcctgtcacgctagagctccccccgccgccaccgccgccccccacgcgcccgaccgttccccccctgccggctccgtcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagccccggtctcgtgcagttcgcccgcgccaccgacacctacttcagcttgggaaacaagtttagaaaccccaccgtggcccccacccacgatgtaaccacggaccgctcgcaaaggctgaccctgcgttttgtgcccgtagaccgggaggacaccgcgtactcttacaaagtgcgctacacgctggccgtaggggacaaccgagtgctggacatggccagcacctactttgacatccggggagtgctggatcgcggtcccagttttaagccctactcgggtaccgcgtacaattccctggctcccaagggcgctcccaaccctgcagaatggacgaattcagacagcaaagttaaagtgagggcacaggcgccttttgttagctcgtatggtgctacagcgattacaaaagagggtattcaggtgggagtaaccttaacagactccggatcaacaccacagtatgcagataaaacgtatcagcctgagccgcaaattggagaactacagtggaacagcgatgttggaaccgatgacaaaatagcaggaagagtgctaaagaaaacaacgcccatgttcccttgttacggctcatatgccaggcccactaatgaaaaaggaggacaggcaacaccgtccgctagtcaagacgtgcaaaatcccgaattacaattttttgcctctactaatgtcgccaatacaccaaaagcagttctatatgcggaggacgtgtcaattgaagcgccagacactcacttggtgttcaaaccaacagtcactgaaggcattacaagttcagaggctctactgacccaacaagctgctcccaaccgtccaaactacatagcctttagagataattttattggtctcatgtactacaatagcacaggtaacatgggagtactggcaggccaggcttctcagctaaatgcagttgttgacctgcaagacagaaatactgagctgtcctaccaactcatgttggacgccctcggagaccgcagtcggtacttttctatgtggaaccaagctgtggatagttacgatcctgatgtaagaatcatagaaaaccatggcgtagaagatgaattgcctaattattgctttcctttgggaggcatggcagtaaccgacacctactcgcctataaaggttaatggaggaggcaatggatgggaagccaataacggcgttttcaccgaaagaggagtggaaataggttcagggaacatgtttgccatggagattaacctgcaagccaatctgtggcgcagtttcttgtattccaatatcgggctgtatctcccggactctttaaaaatcactcctgacaacatcacgctgccagaaaacaaaaccacctaccagtacatgaacggccgcgtaacgccacccgggctggtggacacctacgttaacgtgggcgcgcgctggtcccccgatgtcatggacagtattaacccttttaatcaccaccgcaacgccggactccgctaccgttccatgctcctgggaaacggacgctacgtgcccttccacattcaggtgccccagaaattctttgcaattaaaaacctgctgctgctccccggttcctatacctacgagtggaacttccgcaaggacgtgaacatgattttgcagagctcgctgggtaacgacctgcgagttgacggggccagcatacgcttcgacagcatcaacctgtatgctaactttttccccatggcccacaacacggcctccaccctggaagccatgctgcgcaacgacaccaatgaccagtccttcaacgactacctgtgcgcagctaacatgctgtaccccatccccgccaacgccaccagcgtgcccatctccatcccgtctcgcaactgggccgcctttaggggttggagtttcacccgcctcaaaaccaaggaaaccccctcgctgggctccgggttcgacccctacttcgtctactccggctccatcccctacctggacggcaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctggttcaaatgctcagccattacaacatcggctaccagggcttctacgtgcccgagaattacaaggaccgcatgtactccttctttagaaacttccaacccatgagccgccaaatagtagactcaacggcttacactaactatcaggatgtgaaactgccataccagcataacaactcagggttcgtgggctacatgggacccaccatgcgagagggacaggcctacccggccaactatccgtaccccctgattggggccaccgccgtgcccagcctgacgcagaaaaagttcctctgcgaccgggtgatgtggaggattcccttctctagcaacttcatgtctatgggttccctcaccgacctggggcagaacatgctgtacgccaactccgctcacgccttggacatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcgttttcccggcttcatgtccccccacaagccggcctgtgccatcgttaacacggccggacgggagaccggaggggtgcactggctcgccttcgcctggaacccgcgtaaccgaacctgctacctgttcgacccttttggtttctccgacgagaggctgaaacagatttaccagttcgagtacgaggggctcctcaagcgcagcgctctggcttccaccccagaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaatcaggaacacctgtatcgctttctggggaaacactctgcctacttccgccgccaccggcagcgcatcgaacgggccacggcctttgaaagcatgagccaaagagtgtaatcaataaaaaccatttttatttgacatgatacgcgcttctggcgtttttattaaaaatcaaagggttcgagggaggggtcctcgtgcccgctggggagggacacgttgcgatactggaaacgggcgctccaacgaaactcggggatcaccagccgcggcaggggcacgtcttctaggttctgcttccaaaactgccgcaccagctgcagggctcccatgacgtcgggcgccgataccttgaagtcgcagttagggccggagctcccgcggctgttgcggaacacggggttggcacactggaacaccagcacgccggggttgtggatactggccagggccgtcgggtcggtcacctccgacgcatccagatcctcggcgttgctcagggcaaacggggtcagcttacacatctgccgcccaatctggggtactaggtcgcgcttgttgaggcagtcgcagcgcagagggatcaggatgcgccgctgcccgcgttgcatgatagggtaactcgccgccaggaactcctccatttgacggaaggccatctgggctttagcgccctcggcgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgaccgttctcgctggttacatccatttccaacacgtgctccttgcagaccatctccactccgtggaagcagaacaggacgccctcctgctgggtactgcgatgctcccatacggcacatccggtgggctcccagctcttgtgttttacccccgcgtaggcttccatgtaagccattaggaatctgcccatcagctcggtaaaggtcttctgattggtgaaggtcagcggcaggccgcggtgctcctcgttcaaccaagtttgacagatcttgcggtacacggctccctggtcgggcagaaacttaaaagcccctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagctgaggcgcctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggcagtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgatcgtcttcagctactttgagctgccggacgagcaccctcagggtccggctcacgggttgaaactcgagatcgagaacgcgctcgagtctcgcctcatcgacaccttcaccgcccgacctctcctggtagaaatccaacgggggatcactaccatcaccctgttttgcatctgttccacacccgaattacatgaagatctgtgttgtcatctttgtgctgaatttaataaatagctgttggacttcatctgaggacaactttgtgccctttaaaggtaccatagacaccattgttttctctgaatctaccaattcaattaccttaaattgcacctgcgctaacgaactaattcagtggcgagccaacagacgggcctgtagagggggctatcctctgtcactgtcacgcacctgattgcatgtccaaactaatcaaaactctctgtgctttaggtgatatttttaagatgtaaatcaataataaacttaccttaaatttgacaacaattttctggtgacatcattcagcagcaccactttaccctcttcccagctctcgtatgggatgcgatagtgggtggcaaacttcctccaaaccctaaaagaaatattggtatccacttccttgtcctcacccacaattttcatcttttcatagatgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtcctctccgcgtcacagacaacaaacttacatttaacttcacatcaccactccgttatgaaaatgaaaaccttacttttaaatatacagagcctcttaaacttataaataacagccttgccattgacatcaattcctcaaaaggccttagtagcgtcggaggctcacttgctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccacttataaacaacgcctttagtattcgacagaacgacagtacggcctcaaaccctacctacaacgccctggcgtttatgcctaacagtaccatatatgcaagagggggaggtggtgagccacgaaacaactactacgtccaaacgtatcttaggggaaatgttcaaaaaccaatcattcttactgtaacctacaactcagctgccacaggatattccttatcttttaagtggactgctcttgcacgtgaaaagtttgcaaccccaacaacttcgttttgctacattacagaacaataaaaccgtgtaccccaccgtttcgtttttttcagatgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacaattaaactaggaaacggcctcactctagacaaccagggacaactaacatcaaccgctggggaagtagaacctccactcactaacgctaacaacaaacttgcactggtctatagcgaacctttagcagtaaagcgcaacagcctaaccttatcgcacaccgctccccttgttattgctgataactctttagcattgcaagtttcagaacctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatactggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcgatggaaacatagctgtttctcctcaagttacatcgcctgacaccttatggaccactgccgatccatccccaaattgttccatctacactgatttagatgccaaaatgtggctctcgttggtaaaacaagggggtatggttcacggttctgttgctttaaaagcattaaaaggaaccctattgagtcctacggaaagtgccattgttattatactacattttgacaattatggagtgcgaattctcaattatcccactttgggcactcaaggcacattgggaaataatgcaacctggggttataggcagggagaatctgcagacactaatgtactcaatgcactagcatttatgcccagttcaaaaaggtacccaagagggcgtggaagcgaagttcaaaatcaaactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataaaacaactttcttttttaatttcttttttattttacacgaacagtaagacttcctccccccctccatttgacagcatacaccagcctctcccccttcatggcagtaaactgttgtgagccagtccggtatttgggagtcaagatccaaacagtctctttggtgataaaacgtggatccgtgatggacacaaatccctgggacaggttctccaacgtttcggtaaaaaactgcgtgccaccctacaaaacaaacaggttcaggctctccacgggttatctccccgatcaaactcatacagggtaaaggtgcgatgatgttccactaaaccacgcaggtggcgctgtctgaacctctcggtgcgactcctgtgaggctggtaagaagttagattgtccagcagcctcacagcacgtatcatcagtctacgagtacgtctggcgcagcagcgcatttgaatctcactgagatttcggcaagaatcgcacaccatcacaatcaggttgttcataatcccatagctgaacacgctccagccaaagctcattcgctccaacagcgccaccgcgtgtccgtccaaccttactttaacataaatcaggtgtctgccgcgtacaaacatactacccgcatacagaacttcccggggcaaacccctgttcaccacctgcctgtaccagggaaacctcacatttatcagggagccatagatagccattttaaaccaattagctaacaccgccccaccagctctacactgaagagaaccgggagagttacaatgacagtgaataatccatctctcatagcccctgattacctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccggcgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcaatgcacacctcaaacctacagatgtctcggtacagttccaaacacgtagtgagggcgagttccaaccaagacagacaggctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccactgccaaagttcacccacacccacgaaacccgcgaaaatccagcgccgtcagcacttccgcaatttcagtctcacaacgtcacttccgcgcgccttttcacattcccacacccgcccacaaaccccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaat

SEQ ID NO: 226 - DNA, 6080 bp, Artificial Sequence
  Synthetic oligonucleotide RhAdApt55.Empty
catcatcaataatataccttattctggaaacgtgccaatatgataatgagcggggaggagcgaggcggggccggggtgacgtgcggtgacgcgggctgacgcgggtggcgcggggtggcgcgagggcggggcgggtgtggggaggcgcttagtttttacgtatgcggaaggaggttttataccggaagttgggtaatttgggcgtatacttgtaagttttgtgtaatttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagcctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaatgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaggatgccctgaatgtgatcctgactcgcctggagatcatgtcacgtcgcctggacgaactggctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 227 - DNA, 38569 bp, Artificial Sequence
  Synthetic oligonucleotide pWe.RhAd55.pIX-rITR.dE3
gacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaatgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaggatgccctgaatgtgatcctgactcgcctggagatcatgtcacgtcgcctggacgaactggctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacaaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttttcggcccggtagaggatctgcctgaagatggcgtgggagttggaagagatggtggggcgttggaagacgttaaagttggctccgggcagtcccacggagtcttggatgaactgggcgtaggattcccggagcttgcccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccattggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagtccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtgtacgtcgcccgagttgtcttgataggcgatctcggccatgaactgctccacttcttcctcgcggaggtcgccgtggcccgctcgctctacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggagacggatgagatcggcgaccgtgtcgcgtacctcctgctcgaaagcgccccgaggcgcctctgcttcttcctccggctcctcctcttccaggggcatgggttcctccgacagctctgcgacggggacggggcggcgacgtcgtcgtctgaccggcaggcggtccacgaagcgctcgatcatttcaccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggtcgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttaatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtgaggaggcggctctcggtacaggggccagccaacggtggcgggagcgccgggggacaggtcatccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctggcccgtgaggcgggcgcaatcttgtacgctctagatggaaaaaagacagggcggtcatggactcccttccgtagctcggggggtaaagtcgcaagggtgcggcggcggggaaccccggttcgagaccggctggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagagttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagtcgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacgtgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggtcaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtaccgtcgcgcaccaacccgacgcacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgccttaccacggacgtgaaggaggcgctggctcagaaggagcggtttctgagggatagcaatctgggttctctggtggcactgaacgcctttctgagcacgcagccggccaacgtgccccgcgggcaggaggattacgtgagcttcatcagcgctctgagactgctggtgtccgaggtgccccagagcgaggtgtaccagtctgggccggattacttttttcagacgtcccgacagggcttgcaaacggtgaacctgactcaggcctttaaaaacttgcaaggtatgtggggcgttaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagattgacgagcatacatatcaggagatcactaacgtgagccgggccctgggtcaggaagataccggcagcctggaagccacgttgaactttttgctaaccaaccggaggcaaaaaataccctcccagtttacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggcgagtttgacctgcccgaagccgacgacggctttctttgggacgacgtgtccgacagcattttcacgccgggcaatcgccgattccagaagaaggagggcggagacgagctccccctctccagcgtggaggcggcctctaggggagagagtccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaactcggcagccccgatacgagtggttcgagtttaccattccagagggcaactattccgaaactatgactatcgatctcatgaataacgcgatcgtggacaattacctgcaagtggggagacagaacggggtgctggaaagcgatatcggcgtgaaattcgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttaggaattagaaagcgccgcccattccaagagggctttcaaatcatgtatgaggacctggagggaggtaatatacccgccttactggacgtgtcgaagtacgaagctagcatacaacgcgccaaagcggagggtagagagattcggggagacacctttgcggtagctccccaggacctggaaatagtgcctttaactaaagacagcaaagacagaagctacaatattataaacaacacgacggacaccctgtatcggagctggtttctggcttacaactacggagaccccgagaaaggagtgagatcatggaccatactcaccaccacggacgtgacctgtggctcgcagcaagtgtactggtccctgccggatatgatgcaagacccggtcaccttccgcccctccacccaagtcagcaacttcccggtggtgggcaccgagctgctgcccgtccatgccaagagcttctacaacgagcaggccgtctactcgcaacttattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtggtggctcctaaagttctttctagtcgcaccttctaaaaacatgtccatcctcatctctcccgataacaacaccggctggggactgggctccggcaagatgtacaacaacaccggctggggactgggctccggcaagatgtacggcggagccaaaaggcgctccagtcagcacccagttcgagttcggggccacttccgcgctccttggggagcttacaagcgaggactctcgggtcgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggcaggcagaagggctatgcgccgcgctgccgccaacgccgccgccgggagggcccgccgacaggctgcccgccaggctgctgctgccatcgctagcatggccagacccaggagagggaacgtgtactgggtgcgtgattctgtgacgggagtccgagtgccggtgcgcagccgacctccccgaagttagaagatccaagctgcgaagacggcgtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggaggatggcggagtggaatttattaggagtttcgccccgcgacgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaattaaaagagaaatggaagatctgcatcccaccatccaactcatggtccctaaacggcagaggctggaagaggtcctggagaagatgaaagtggaccccagcatagagccggatgtaaaagtcagacctattaaggaagtggcccccggtcttggggtgcaaacggtggacattcaaatccccgtcaccaccgcttcaaccgccgtggaagccatggaaacgcaaacggaaacccctgccgcgatcggtaccagggaagtggcgttgcaaacggagccttggtacgaatacgccgcccctcggcgtcagaggcgttccgctcgttacggccccgccaacgccatcatgccagaatatgcgctgcatccgtctatactgcccactcccggataccggggtgtgacgtatcgcccgtctggaacccgccgccgaacccgtcgccgccgccgctcccgtcgcgctctggcccccgtgtcggtgcggcgtgtgacccgccggggaaagacagtcgtcattcccaacccgcgttaccaccctagcatcctttaataactctgccgttttgcagatggctctgacttgccgcgtgcgccttcccgttccgcactatcgaggaagatctcgtcgtaggagaggcatgacgggcagtggtcgccggcgggctttgcgcaggcgcatgaaaggcggaattttacccgccctgatacccataattgccgccgccatcggtgccatacccggcgttgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcaaatgctccgagataaactgaaggacaccaacttccaagaaaaagtggtcaatggggtggtgaccggcatccacggtgcggtagatctcgccaaccaagcggtgcagaaagagattgacaggcgtttggaaaactcgcgggtgccgccgcagaggggggatgaggtggaggtcgaggaagtagaagtagaggaaaagctgcccccgctggagaaagttcccggtgcgcctccgaggccgcaaaagcggcccaggccagaactagaagaaactctggtgacggagagcaaggagcctccctcgtacgagcaagccttgaaagagggcgcctctccaccctcctacccgatgactaagccgatcgcacccatggctcgaccggtgtacgggaaggactacaagcctgtcacgctagagctccccccgccaccaccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagtgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggatcgctcgcagaggctgaccctgcgcttcgtgcccgtagaccgggaggacaccgcgtactcttacaaagtgcgctacacgctggccgtaggggacaaccgggtgctcgacatggccagcacctactttgacatccggggggtgctcgatcgcggtcccagcttcaagccctattcggggaccgcctacaactccctggctcccaagggcgcccccaaccccgctgaatgggcagattctgacagcaaactgaaagtgagggcacaggcaccttttgtcagctcctacggtaataatgcgattacaaaggaaggtattcaggtaggagtaattttaacagactccggacaaacagcacaatatgcggacaaaacgtatcagcctgagccgcagattggagaactacagtggaacagcgaagtaggaaccaatgataaagtagcgggaagggtgcttaagaagacgactccaatgtttccctgttatggttcatacgccaagcctaccaatgcaaaaggagggcaggcgacacagcctgctagtcaagaaactcaaaatccagaattgcagttttttgctgcttccagcaccaccgtcaacactccaaaagcagtattatacgcagaggacgtgtctattgaagctccagacactcacctggtatttaaaccatcagtaactgaaggaactacaagttcggaagctctactgacacaacaagctgcccctaacaggccaaactatattgcctttcgggacaattttattggcctaatgtattacaatagcactggaaacatgggagtgctggccggacaggcgtcgcaactcaatgcggtggtcgatttgcaagacagaaacacagaactgtcataccagctaatgcttgacgctctgggagatagaagtcgctacttctctatgtggaatcaagccgtggacagttacgatccagatgttagaatagtggaaaatcacggcgtcgaagatgaattgcctaattactgcttccctttgggcggtatggcagtgactgacacctactcgcctataaagcttaatggtgggcaaaacggatgggaagctaataatgacgtttatgccgaaagaggagtggaaataggctcagggaacctgttcgccatggagatcaacctgcaggccaacctgtggcgcagtttcttgtattccaacatcgggctgtatctccccgactccctaaaaatcacccccgacaatatcacgctgccagagaacaaaaacacttatcagtacatgaacggtcgcgtgacacctcccgggctcatagacacctacgtcaacgtgggtgcgcgctggtcccccgatgttatggacagcatcaaccccttcaaccaccaccgcaacgcggggctgcgttaccgctccatgctgctgggcaacggccgctacgtgcccttccacatccaggtgccccagaaattctttgccattaagaacctgctgctgctccccggttcctacacctacgagtggaacttccgcaaggacgtcaacatgatcttgcagagctcgctgggcaatgacctgcgagtggacggggccagcatccgcttcgacagcatcaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtgatgtggaggatccccttctctagcaacttcatgtcgatgggctccctcaccgacctggggcagaacatgctgtacgccaactccgcgcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggttccagcgaacaggagttgcaggccattgttcgcgacctgggctgcgggccctactttttgggcaccttcgacaagcgttttcccggcttcatgtccccccacaagccggcctgcgccatcgttaacacggccggacgggagaccgggggggtgcactggctcgccttcgcctggaacccgcgcaaccgcacctgctacctgttcgacccttttggtttctccgacgaaaggctgaagcagatctaccaattcgagtacgaggggctcctcaagcgcagcgctctggcttccaccccagaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgagcaggccacggcctttgaaagcatgagccaaagagtgtaatcaataaaaaccattttttatttaacatgatacgcgcttctggcgtttttattagaaatcgaagggttcgagggaggggtcctcgtgcccgctgggaagggacacgttgcggtactggaaacgggcgctccaacgaaactcggggatcaccagccgcggcaggggcacgtcttctaggttctgcttccaaaactgccgcaccagctgcagggctcccatcacgtcgggcgccgagatcttgaagtcgcagttagggccggagctcccgcggctgttgcggaacacggggttggcacactggaacaccagcacgcctgggttgtggatactggccagggccgtcggatcggtcacctccgacgcgtccagatcctcggcgttgctcagggcaaacggggtcagcttgcacatctgccgcccgatctggggcaccaggtcgggtttgttgaggcaatcgcagcgcagagggatcaggatgcgtcgctgcccgcgttgcatgatagggtaactcgccgccaggaactcctccatttgacggaaggccatctgggctttgacgccctcggtgaaaaacagcccacaggacttgctagaaaatacgttattgccgcagttaatgtcttccgcgcagcagcgtgcatcttcgttcttcagctgaaccacgttacgcccccagcggttctggaccaccttggctttcgtaggatgctccttcagcgcccgctgcccgttctcgctggtcacatccatttccaccacgtgctccttgcagaccatctccactccgtggaagcaaaacaggacgccctcctgccgggtattgcgatgctcccatacggcgcatccggtgggctcccagctcttgtgttttacccccgcgtaggcttccatgtaagccatgaggaatctgcccatcagctcggtgaaggtcttctgattggtgaaggttagcggcaggccgcggtgctcctcgttcaaccaagtttgacagatcttgcggtacacggctccctggtcgggcagaaacttaaaagccgctctgctgtcgttgtccacgtggaacttctccatcaacatcgtcatgacttccatgcccttctcccaggcagtcaccagcggcgcgctctcggggttcttcaccaacacggcggtagaggggccctcgccggccccgacgtccttcatggtcattctttgaaactccacggagccgtccgcgcgacgtactctgcgcaccggagggtagctgaagcccacctccaccacggtgccttcgccctcgctgtcggagacaatctccggggatggcggcggcggcgcgggtgttgccttgcgagccttcttcttgggagggagcggaggcacctcctgctcgcgctcggggctcatctcccgcaagtagggggttatggagctgcctgcttggttctgacggttggccattgtatcctaggcagaaagacatggagcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggaaggggacaacgcgcgtctggccgtcctcaagcgctgcatagaagtttcccacttcgcctaccccgccctcaacctgccgcccaaagttatgaaatcggtcatggatcagctactcatcaagagagctgagcccctggatcccgaccaccctgaggcggaaaactcagaggacggaaagcccgtcgtcagcgacgaggagctccagcggtggctggagaccaaagacccccagcagttgcaagagaggcgtaagatgatgatggcggccgtgctggtcaccgtggagctagaatgcctgcaacggtttttcagcgacgtggaaacgctgcgcaaaatcggggagtccctgcactacaccttccgccagggctacgtccgccaggcctgtaagatctccaacgtggagctcagcaacctggtctcctacatgggcatcctccacgagaaccggctggggcagagcgtgctgcactgcaccttgcagggcgaggcgcggagggactacgtccgcgactgcgtctacctcttcctcacccttacctggcagaccgccatgggcgtctggcagcagtgcttggaagagagaaacctcaaagagctagacaaactcctctgccgccagcggcgcgccctgtggtccggtttcagcgaacgcactgtcgcctgcgccctggcagacatcattttcccggagcgcctgatgaaaaccctgcagaacggcctgccggatttcataagtcagagcatcttgcaaaacttccgctccttcgtcctggagcgctccgggatcttgcccgccatgagctgcgcgctaccttctgactttgttcccctttcctaccgcgagtgccctcccccactgtggagccactgctacctcttccaactggccaactttctggcctaccactccgacctcatggaagacgtgagcggagaggggctgctcgagtgccactgtcgctgcaacctctgcaccccccacagatcgctggcttgcaacaccgagctgctcagcgagacccaggtcataggtaccttcgagatccagggaccccagcagcaagagggtgcttccggcttgaagctcactccggcgctgtggacctcggcttacttacgcaaatttgtagccgaggactaccacgcccacaaaattcggttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagaactgtgggacagccaggcagaggaggtgtcagaggacgaggaggagatggaaagctgggacagcctagacgaggaggaggacgagctttcagaggaagagacgaccgaagaaaaaccacctgcatccagcgcgccttctctgagccgacagccgaagccccgacccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacggtacctcctcttccatcacggtgtggccttccctcgcaacgttctctattattaccgtcatctctacagcccctacgaaacgctcggagaaaaaagctaaggcctcctctgccgcgaggaaaaactccgccgctgccgccgccgccaaggatccaccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcagtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcgcctggacgctacccggacgccttcattcccaactttgacgcagtgagtgaatccgtggacggctacgactgatgacagatggtgcggccgtgagagctcggttgcgacatctgcatcactgccgtcagcctcgctgctacgctcgggaggcgatcgtgttcagctactttgagctgccggacgagcaccctcagggaccggctcacgggttgaaactcgagatcgagaacgcgctcgagtctcgcctcatcgacgccttcaccgcccgacctctcctggtggaaaccgaacgcgggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctcccagaggtatcatacaaactgtttactttgacaactctactactctcctaaccctcaactgcgcttgcactaacgggacctgtcgaggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctgagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcaggtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttaacagcgagccccaactgggcgtacactttaatccccctatcaccgtgcaacaaggcggtctggccttaaatacgggggatggtttgcaagtatatcttaacaaactaacgctaaacataggcagagacttgcaatatgaaaacgggtcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgagtcagtccggtatttgggagttaagatccaaacagtctctttggtaatcagatgtcgatccgtgatggacacaaatccctggggcaggttctccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcactgagattccggcagcctcacagcatggatgatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcaaacccctgttcaccacctgcctgtaccagggaaacctcacatttatcagggagccatagatagccattttaaaccaattagctaacaccgccccaccagctctacactgaagagaaccgggagagttacaatgacagtgaatgatccatctctcataacccctgatggtctgatggaaatccagatctaacgtggcacaacagatacacactttcatatacattttcatcacatgtttttcccaggccgttaaaatacaatcccaatacacgggccactcctgcagtacaataaaactaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagaaaccgacgcacttcctcgtacttgtagtagcagaaccacgtccgctgccagcacgtctccaagtaacgccggtccctgcgtcgctcacgctccctcctcaacgcaaagtgcagccactcgccactcttgtaatccacacactcggcctccggggtgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaggtaattttcatttctccactcgcgaataatgtcgcggcaaatagtctgaaggttcatgccgtgcatattaaaaagctccgaaagggcgccctctatagccatgcgtagacacaccatcatgccgggcatattaaaaaggctccgaaagggcgccctctatagccatgcgtagacacaccatcatgactgcaatatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgtgcaaccaaaaatcactaagctgctcctttaaaaagtccagtacttctatattcagtccgtgcaagtactgaagcaactgtgcgggaatatgcacaacaaaaaaaatagggcggctcagatacatgttgacctaaaataaaaagaattattaaactaaagaagcttggcgaacggtgggataaatgacacgctccagcagcagacaggcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagcgggaatatccaacgacagctgcaaagacagcaaaacaatccctctgggagcaatcacaaaatcctccggtgaaaaaagcacatacatattagaataaccctgttgctggggcaaaaaggcccggcgtcccagcaaatgcacataaatatgttcatcagccattgccccgtcttaccgcgtaaacagccaggaaaaaatcgagctaaaatccacccaacagcctatagctatatatacactccgcccaatgacgctaataccgcaccacccacgaccaaagttcacccacacccacaaaacccgcgaaaatccagcgccgtcagcacttccgcaatttcagtctcacaacgtcacttccgcgcgccttttcactttcccacacacgcccttcgcccgccccgccctcgcgccaccccgcgtcaccccacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 228 - DNA, 6105 bp, Artificial Sequence
  Synthetic oligonucleotide RhAdApt56.Empty
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgtcaccgaggagctgaggacggaccaccacatgctgtcttgcctgcgtaccgactatgaatccagtgatgaggagtgaggtgaggggcggagccacaaagggtataaaggggcatgaagggtggacgcggtgtttcaaaatgagcgggacgacggacggcaatgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactatataaccaactggccactgcagctgtggcgtctcggtctctggttcaagaagatgccctgaatgtgatcttgactcgcctggagatcatgtcacgtcgcctggacgaactggctgcgcagatatcccaagctaaccccgataccgcttcagaatcttaaataaagacaaacaaatttgttgaaaagtaaaatggctttatttgttttttttggctcggtaggctcgggtccacctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggagagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactcttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 229 - DNA, 5828 bp, Artificial Sequence
  Synthetic oligonucleotide RhAdApt56.v2.Empty
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccggtgaggggcggagccacaaagggtataaaggggcatgaagggtggacgcggtgtttcaaaatgagcgggacgacggacggcaatgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactatataaccaactggccactgcagctgtggcgtctcggtctctggttcaagaagatgccctgaatgtgatcttgactcgcctggagatcatgtcacgtcgcctggacgaactggctgcgcagatatcccaagctaaccccgataccgcttcagaatcttaaataaagacaaacaaatttgttgaaaagtaaaatggctttatttgttttttttggctcggtaggctcgggtccacctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggagagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactcttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 230 - DNA, 37726 bp, Artificial Sequence
  Synthetic oligonucleotide pWe.RhAd56.pIX-rITR.dE3
gtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgtcaccgaggagctgaggacggaccaccacatgctgtcttgcctgcgtaccgactatgaatccagtgatgaggagtgaggtgaggggcggagccacaaagggtataaaggggcatgaagggtggacgcggtgtttcaaaatgagcgggacgacggacggcaatgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactatataaccaactggccactgcagctgtggcgtctcggtctctggttcaagaagatgccctgaatgtgatcttgactcgcctggagatcatgtcacgtcgcctggacgaactggctgcgcagatatcccaagctaaccccgataccgcttcagaatcttaaataaagacaaacaaatttgttgaaaagtaaaatggctttatttgttttttttggctcggtaggctcgggtccacctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggagagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggtggatttgatatttacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgattaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccggacagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggatgggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtgtcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgtagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttggatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcgaccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggatcccgcacttttggcatccatgcagagtcaaccttcgggcgtgaccgcctccgatgactgggcggcggccatggaccgcatcatggcgctgaccacccgcaaccccgaggcttttagacagcaaccccaggccaaccgtttttcggccatcttggaagcggtggtaccgtcgcgcaccaacccgacgcacgagaaagtcctgactatcgtaaacgccctggtagacagcaaggccatccgccgcgacgaggcgggcttgatttacaacgctctgctggaacgggtggcgcgctacaacagcactaacgttcagaccaatctggatcgtctcaccaccgacgtgaaggaggcgctggctcagaaggagcgctttctgagggacagcaatctgggctctctggtggcactcaacgccttcctgagcacgcagccggccaacgtgccccgcgggcaggaggactacgtgagctttatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgcgactcgtacctgggtcatctcatcactctgtaccgcgaggccatcggtcaggctcagattgacgagcatacatatcaggagatcactaacgtgagccgggccctgggtcaggaagataccggcagcctggaggccacgttgaactttttgctaaccaaccggaggcaaaaaataccctcccagttcacgttaagcgccgaggaggagaggattctgcgatacgtgcagcagtccgtgagtctgtacttgatgcgggagggcgccaccgcttccacggctttagacatgacagctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctttgggacgacgtgtccgacagcattttcacgccggacaatcgccgattccagaagaaggagggcggagacgagctccccctctccagcgtggaggcggcctctaggggagagagcccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattaccaaaacgatcacagcaactttctgactaccgtggtgcagaacaatgacttcaccccgacggaggcgggcacgcagaccattaactttgacgagcgttcccgctggggcggtcagctgaaaaccattctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtgaaatttgataccagaaacttccgactggggtgggatcccgtgaccaagctggtaatgccaggcgtgtacaccaacgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcagcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctaccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctctggccgaacggctgtagacgataccatagacgccgtgattgccgacgcccgccggtacaaccccggaccggtcgctagcgccgcctccaccgtggattccgtgatagacagtgtggtggccggcgccagggcatatgctcgccgcaagaggcggctgcatcggaaacgtcgccccaccgccgccatgctagcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgttacgtcagcttcaaccgccgtggaagccatggaaacgcaaaccgaaacccccgccgcggttggtacgaaagaagtggcgttgcaaaccgacccctggtacgaatttgccaccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgcagccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgagggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacgatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcctggaacccgcgtaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacaaccccatggagcgcaaccccaccatggatctgctcaccggagtgcccaacagcatgcttcacagcccccaggtcgcccccaccctgcgccgtaaccaggaacacctgtatcgctttctggggaaacactctgcctatttccgccgccaccggcagcgcatcgagcaggccacggcctttgaaagcatgagccaaagagtgtaatcaataaaaaccatttttatttaacatgatacgcgcttctggcgtttttattaaaaatcgaacggttcgagggaggggtcctcgtgcccgctgggaagggacacgttgcggtactggaaacgggcgctccaacgaaactcggggatcaccagccgcggcaggggcacgtcttctaggttctgcttccagaactgccgcaccagctgcagggctcccatgacgtcgggcgccgagatcttgaagtcgcagttagggccggagcccccgcggctgttgcggaacacggggttggcacactggaacaccagcacgctggggttgtaaatactggccagggccgttgggtcggtcacctccgacgcatccagatcctcggcattgctcagggcgaacggagtcagcttgcacatctgccgtccgatctggggcaccaggtcgggtttgttgaggcaatcgcagcgcagagggattaggatgcgacgctgcccgcgttgcatgatagggtaactcgccgccaggaactcctccatctgacggaaggccatctgggccttggtaccctcggtgaaaaatagcccacaggacttgctagaaaatacgttattgccgcagttgatgtcttccgcgcagcagcgtgcatcttcgttcttcagctgaaccacgttacgcccccagcggttctggaccaccttggctttcgtaggatgctccttcaacgcccgctgaccgttctcgctggtcacatccatttccaccacgtgctccttgcagaccatctccactccgtggaagcagaacaggacgccctcctgctgggtattgcgatgctcccaaacggcacatccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagccgctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttggaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcagccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaactctcggagaaaaaagctaaggcctcctctgccgcgaggaaaaactccgccgccgctgccgccgccaaggatccgccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcattgccagcatgagcaaggagattcccaccccttacatgtggagctatcagccccagatgggcctggccgcgggggccgcccaggactactccagcaagatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttttccggctcacctggacgctacccggacgccttcattcccaactttgacgcagtgagtgaatccgtggacggctacgactgatgacagatggtgcggccgtgagagctcggctgcgacatctgcatcactgccgccagcctcgctgctacgctcgggaggcgatcgtgttcagctactttgagctgccggacgagcaccctcaggggccggctcacgggttgaaactcgagatcgagaacgcgctcgagtctcgcctcatcgacgccttcaccgcccggcctctcctggtagaaaccgaacgcgggatcactaccatcaccctgttctgcatctgccccacgcccggattacatgaagatctgtgttgtcatctttgcgctcagtttaataaaaactgaactgtttgccgcaccttcaacgccatctgtgatttctacaacaaaaagttcttctggcaaaggtacacaaactgtattttattctaattctacctcatctattgtgctgaactgcgcctgcactaacgaacttatccgtagagggggctatcctctgtcactgtcacgcacctgattgcatgtccaaactaatcaaaactctctgtgctttaggtgatatttttaaaatgtaaatcataataaacttaccttaaatttgacaacaattttctggtgacatcattcagcagcaccactttaccctcttcccagctctcgtatgggatgcgatagtgggtggcaaacttcctccaaaccctaaaagaaatattggtatccacttccttgtcctcacccacaattttcatcttttcatagatgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtccgctccgcgtcacagacaacaaacttacatttaacttcacatcaccactccgttatgaaaatgaaaaccttacttttaactatacagagcctcttaaacttataaataacagccttgccattgacatcaattcctcaaaaggccttagtagcgtcggaggctcactagctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccgcttataaacaacgcctttagtattcgacagaatgacagtacggcctcaaaccctacctacaacgccctggcgtttatgcctaacagtaccatatatgcaagagggggaggtggtgaaccacgaaacaactactacgtccaaacgtatcttaggggaaatgttcaaaaaccaatcattcttactgtaacctacaactcagccgccacaggatattccttatcttttaagtggactgctcttgcacgtgaaaagtttgcaaccccaacaacttcgttttgctacattacagaacaataaaaccgtgtaccccaccgtttcgtttttttcagatgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacagttaaactaggaaacggcctcactctagacaaccagggacaactaacatcaaccgctggggaagtagaacctccactcactaacgctaacaacaaacttgcactggtctatagcgatcctttagcagtaaagcgcaacagcctaaccttatcgcacaccgctccccttgttattgctgataactctttagcattgcaagtttcagagcctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatagtggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcaatggaaacatagctgtttctcctcaagttacatcgcctgacaccttatggaccactgccgatccatcccccaattgttccatctacactgatttagatgccaaaatgtggctctcgttggtaaaacaagggggtgtggttcacggttctgttgctttaaaagcattgaaaggaaccctattgagtcctacggaaagtgccattgttattatactacattttgacaattatggagtgcgaattctcaattatcccactttgggcactcaaggcacgttgggaaataatgcaacttggggttataggcagggagaatctgcagacactaatgtactcaatgcactagcatttatgcccagttcaaaaaggtacccaagagggcgtggaagcgaagttcagaatcaaactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataaaacaacttttcctttttattttctttttattttacacgcacagtaaggcttcctccacccttccatttgacagcatacaccagcctctcccccttcatggcagtaaactgctgcgagccagtccggtatttgggagttaagatccaaacagtctctttggtaatcagatgtcgatccgtgatggacacaaatccctggggcaggttctccaacgtttcggtgaaaaactgcatgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagctctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctatgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagtgggaatatccaacgacagctgcaaagacagcaaaataatccctctgggagcaagcacaaaatcctccggtgaaaaaagaacatacatattagaataaccctgttgctggggcaaaaaggcccgacgtcccagcaaatgcacatatatgtgttgatcagccattgccccgtcttaccgcgtataaagccacgaaaaagtcgagctaaaatccacccaacagcctatagctatatatacactccgcccaatgacgctaacaccgtaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 231 - DNA, 37449 bp, Artificial Sequence
  Synthetic oligonucleotide pWe.RhAd56.v2.pIX-rITR.dE3
ggtgaggggcggagccacaaagggtataaaggggcatgaagggtggacgcggtgtttcaaaatgagcgggacgacggacggcaatgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactatataaccaactggccactgcagctgtggcgtctcggtctctggttcaagaagatgccctgaatgtgatcttgactcgcctggagatcatgtcacgtcgcctggacgaactggctgcgcagatatcccaagctaaccccgataccgcttcagaatcttaaataaagacaaacaaatttgttgaaaagtaaaatggctttatttgttttttttggctcggtaggctcgggtccacctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggagagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggtggatttgatatttacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgattaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccggacagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggatgggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtgtcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgtagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttggatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcgaccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggatcccgcacttttggcatccatgcagagtcaaccttcgggcgtgaccgcctccgatgactgggcggcggccatggaccgcatcatggcgctgaccacccgcaaccccgaggcttttagacagcaaccccaggccaaccgtttttcggccatcttggaagcggtggtaccgtcgcgcaccaacccgacgcacgagaaagtcctgactatcgtaaacgccctggtagacagcaaggccatccgccgcgacgaggcgggcttgatttacaacgctctgctggaacgggtggcgcgctacaacagcactaacgttcagaccaatctggatcgtctcaccaccgacgtgaaggaggcgctggctcagaaggagcgctttctgagggacagcaatctgggctctctggtggcactcaacgccttcctgagcacgcagccggccaacgtgccccgcgggcaggaggactacgtgagctttatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgcgactcgtacctgggtcatctcatcactctgtaccgcgaggccatcggtcaggctcagattgacgagcatacatatcaggagatcactaacgtgagccgggccctgggtcaggaagataccggcagcctggaggccacgttgaactttttgctaaccaaccggaggcaaaaaataccctcccagttcacgttaagcgccgaggaggagaggattctgcgatacgtgcagcagtccgtgagtctgtacttgatgcgggagggcgccaccgcttccacggctttagacatgacagctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctttgggacgacgtgtccgacagcattttcacgccggacaatcgccgattccagaagaaggagggcggagacgagctccccctctccagcgtggaggcggcctctaggggagagagcccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattaccaaaacgatcacagcaactttctgactaccgtggtgcagaacaatgacttcaccccgacggaggcgggcacgcagaccattaactttgacgagcgttcccgctggggcggtcagctgaaaaccattctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtgaaatttgataccagaaacttccgactggggtgggatcccgtgaccaagctggtaatgccaggcgtgtacaccaacgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcagcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctaccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctctggccgaacggctgtagacgataccatagacgccgtgattgccgacgcccgccggtacaaccccggaccggtcgctagcgccgcctccaccgtggattccgtgatagacagtgtggtggccggcgccagggcatatgctcgccgcaagaggcggctgcatcggaaacgtcgccccaccgccgccatgctagcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgttacgtcagcttcaaccgccgtggaagccatggaaacgcaaaccgaaacccccgccgcggttggtacgaaagaagtggcgttgcaaaccgacccctggtacgaatttgccaccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgcagccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgagggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacgatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcctggaacccgcgtaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacaaccccatggagcgcaaccccaccatggatctgctcaccggagtgcccaacagcatgcttcacagcccccaggtcgcccccaccctgcgccgtaaccaggaacacctgtatcgctttctggggaaacactctgcctatttccgccgccaccggcagcgcatcgagcaggccacggcctttgaaagcatgagccaaagagtgtaatcaataaaaaccatttttatttaacatgatacgcgcttctggcgtttttattaaaaatcgaacggttcgagggaggggtcctcgtgcccgctgggaagggacacgttgcggtactggaaacgggcgctccaacgaaactcggggatcaccagccgcggcaggggcacgtcttctaggttctgcttccagaactgccgcaccagctgcagggctcccatgacgtcgggcgccgagatcttgaagtcgcagttagggccggagcccccgcggctgttgcggaacacggggttggcacactggaacaccagcacgctggggttgtaaatactggccagggccgttgggtcggtcacctccgacgcatccagatcctcggcattgctcagggcgaacggagtcagcttgcacatctgccgtccgatctggggcaccaggtcgggtttgttgaggcaatcgcagcgcagagggattaggatgcgacgctgcccgcgttgcatgatagggtaactcgccgccaggaactcctccatctgacggaaggccatctgggccttggtaccctcggtgaaaaatagcccacaggacttgctagaaaatacgttattgccgcagttgatgtcttccgcgcagcagcgtgcatcttcgttcttcagctgaaccacgttacgcccccagcggttctggaccaccttggctttcgtaggatgctccttcaacgcccgctgaccgttctcgctggtcacatccatttccaccacgtgctccttgcagaccatctccactccgtggaagcagaacaggacgccctcctgctgggtattgcgatgctcccaaacggcacatccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagccgctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttggaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcagccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaactctcggagaaaaaagctaaggcctcctctgccgcgaggaaaaactccgccgccgctgccgccgccaaggatccgccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcattgccagcatgagcaaggagattcccaccccttacatgtggagctatcagccccagatgggcctggccgcgggggccgcccaggactactccagcaagatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttttccggctcacctggacgctacccggacgccttcattcccaactttgacgcagtgagtgaatccgtggacggctacgactgatgacagatggtgcggccgtgagagctcggctgcgacatctgcatcactgccgccagcctcgctgctacgctcgggaggcgatcgtgttcagctactttgagctgccggacgagcaccctcaggggccggctcacgggttgaaactcgagatcgagaacgcgctcgagtctcgcctcatcgacgccttcaccgcccggcctctcctggtagaaaccgaacgcgggatcactaccatcaccctgttctgcatctgccccacgcccggattacatgaagatctgtgttgtcatctttgcgctcagtttaataaaaactgaactgtttgccgcaccttcaacgccatctgtgatttctacaacaaaaagttcttctggcaaaggtacacaaactgtattttattctaattctacctcatctattgtgctgaactgcgcctgcactaacgaacttatccgtagagggggctatcctctgtcactgtcacgcacctgattgcatgtccaaactaatcaaaactctctgtgctttaggtgatatttttaaaatgtaaatcataataaacttaccttaaatttgacaacaattttctggtgacatcattcagcagcaccactttaccctcttcccagctctcgtatgggatgcgatagtgggtggcaaacttcctccaaaccctaaaagaaatattggtatccacttccttgtcctcacccacaattttcatcttttcatagatgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtccgctccgcgtcacagacaacaaacttacatttaacttcacatcaccactccgttatgaaaatgaaaaccttacttttaactatacagagcctcttaaacttataaataacagccttgccattgacatcaattcctcaaaaggccttagtagcgtcggaggctcactagctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccgcttataaacaacgcctttagtattcgacagaatgacagtacggcctcaaaccctacctacaacgccctggcgtttatgcctaacagtaccatatatgcaagagggggaggtggtgaaccacgaaacaactactacgtccaaacgtatcttaggggaaatgttcaaaaaccaatcattcttactgtaacctacaactcagccgccacaggatattccttatcttttaagtggactgctcttgcacgtgaaaagtttgcaaccccaacaacttcgttttgctacattacagaacaataaaaccgtgtaccccaccgtttcgtttttttcagatgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacagttaaactaggaaacggcctcactctagacaaccagggacaactaacatcaaccgctggggaagtagaacctccactcactaacgctaacaacaaacttgcactggtctatagcgatcctttagcagtaaagcgcaacagcctaaccttatcgcacaccgctccccttgttattgctgataactctttagcattgcaagtttcagagcctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatagtggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcaatggaaacatagctgtttctcctcaagttacatcgcctgacaccttatggaccactgccgatccatcccccaattgttccatctacactgatttagatgccaaaatgtggctctcgttggtaaaacaagggggtgtggttcacggttctgttgctttaaaagcattgaaaggaaccctattgagtcctacggaaagtgccattgttattatactacattttgacaattatggagtgcgaattctcaattatcccactttgggcactcaaggcacgttgggaaataatgcaacttggggttataggcagggagaatctgcagacactaatgtactcaatgcactagcatttatgcccagttcaaaaaggtacccaagagggcgtggaagcgaagttcagaatcaaactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataaaacaacttttcctttttattttctttttattttacacgcacagtaaggcttcctccacccttccatttgacagcatacaccagcctctcccccttcatggcagtaaactgctgcgagccagtccggtatttgggagttaagatccaaacagtctctttggtaatcagatgtcgatccgtgatggacacaaatccctggggcaggttctccaacgtttcggtgaaaaactgcatgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagctctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctatgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagtgggaatatccaacgacagctgcaaagacagcaaaataatccctctgggagcaagcacaaaatcctccggtgaaaaaagaacatacatattagaataaccctgttgctggggcaaaaaggcccgacgtcccagcaaatgcacatatatgtgttgatcagccattgccccgtcttaccgcgtataaagccacgaaaaagtcgagctaaaatccacccaacagcctatagctatatatacactccgcccaatgacgctaacaccgtaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 232 - DNA, 37802 bp, Artificial Sequence
  Synthetic oligonucleotide pWe.RhAd56.pIX-rITR.dE3.5orf6
gtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgtcaccgaggagctgaggacggaccaccacatgctgtcttgcctgcgtaccgactatgaatccagtgatgaggagtgaggtgaggggcggagccacaaagggtataaaggggcatgaagggtggacgcggtgtttcaaaatgagcgggacgacggacggcaatgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactatataaccaactggccactgcagctgtggcgtctcggtctctggttcaagaagatgccctgaatgtgatcttgactcgcctggagatcatgtcacgtcgcctggacgaactggctgcgcagatatcccaagctaaccccgataccgcttcagaatcttaaataaagacaaacaaatttgttgaaaagtaaaatggctttatttgttttttttggctcggtaggctcgggtccacctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggagagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggtggatttgatatttacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgattaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccggacagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggatgggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtgtcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgtagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttggatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcgaccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggatcccgcacttttggcatccatgcagagtcaaccttcgggcgtgaccgcctccgatgactgggcggcggccatggaccgcatcatggcgctgaccacccgcaaccccgaggcttttagacagcaaccccaggccaaccgtttttcggccatcttggaagcggtggtaccgtcgcgcaccaacccgacgcacgagaaagtcctgactatcgtaaacgccctggtagacagcaaggccatccgccgcgacgaggcgggcttgatttacaacgctctgctggaacgggtggcgcgctacaacagcactaacgttcagaccaatctggatcgtctcaccaccgacgtgaaggaggcgctggctcagaaggagcgctttctgagggacagcaatctgggctctctggtggcactcaacgccttcctgagcacgcagccggccaacgtgccccgcgggcaggaggactacgtgagctttatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgcgactcgtacctgggtcatctcatcactctgtaccgcgaggccatcggtcaggctcagattgacgagcatacatatcaggagatcactaacgtgagccgggccctgggtcaggaagataccggcagcctggaggccacgttgaactttttgctaaccaaccggaggcaaaaaataccctcccagttcacgttaagcgccgaggaggagaggattctgcgatacgtgcagcagtccgtgagtctgtacttgatgcgggagggcgccaccgcttccacggctttagacatgacagctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctttgggacgacgtgtccgacagcattttcacgccggacaatcgccgattccagaagaaggagggcggagacgagctccccctctccagcgtggaggcggcctctaggggagagagcccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattaccaaaacgatcacagcaactttctgactaccgtggtgcagaacaatgacttcaccccgacggaggcgggcacgcagaccattaactttgacgagcgttcccgctggggcggtcagctgaaaaccattctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtgaaatttgataccagaaacttccgactggggtgggatcccgtgaccaagctggtaatgccaggcgtgtacaccaacgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcagcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctaccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctctggccgaacggctgtagacgataccatagacgccgtgattgccgacgcccgccggtacaaccccggaccggtcgctagcgccgcctccaccgtggattccgtgatagacagtgtggtggccggcgccagggcatatgctcgccgcaagaggcggctgcatcggaaacgtcgccccaccgccgccatgctagcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgttacgtcagcttcaaccgccgtggaagccatggaaacgcaaaccgaaacccccgccgcggttggtacgaaagaagtggcgttgcaaaccgacccctggtacgaatttgccaccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgcagccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgagggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacgatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcctggaacccgcgtaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacaaccccatggagcgcaaccccaccatggatctgctcaccggagtgcccaacagcatgcttcacagcccccaggtcgcccccaccctgcgccgtaaccaggaacacctgtatcgctttctggggaaacactctgcctatttccgccgccaccggcagcgcatcgagcaggccacggcctttgaaagcatgagccaaagagtgtaatcaataaaaaccatttttatttaacatgatacgcgcttctggcgtttttattaaaaatcgaacggttcgagggaggggtcctcgtgcccgctgggaagggacacgttgcggtactggaaacgggcgctccaacgaaactcggggatcaccagccgcggcaggggcacgtcttctaggttctgcttccagaactgccgcaccagctgcagggctcccatgacgtcgggcgccgagatcttgaagtcgcagttagggccggagcccccgcggctgttgcggaacacggggttggcacactggaacaccagcacgctggggttgtaaatactggccagggccgttgggtcggtcacctccgacgcatccagatcctcggcattgctcagggcgaacggagtcagcttgcacatctgccgtccgatctggggcaccaggtcgggtttgttgaggcaatcgcagcgcagagggattaggatgcgacgctgcccgcgttgcatgatagggtaactcgccgccaggaactcctccatctgacggaaggccatctgggccttggtaccctcggtgaaaaatagcccacaggacttgctagaaaatacgttattgccgcagttgatgtcttccgcgcagcagcgtgcatcttcgttcttcagctgaaccacgttacgcccccagcggttctggaccaccttggctttcgtaggatgctccttcaacgcccgctgaccgttctcgctggtcacatccatttccaccacgtgctccttgcagaccatctccactccgtggaagcagaacaggacgccctcctgctgggtattgcgatgctcccaaacggcacatccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagccgctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttggaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcagccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaactctcggagaaaaaagctaaggcctcctctgccgcgaggaaaaactccgccgccgctgccgccgccaaggatccgccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcattgccagcatgagcaaggagattcccaccccttacatgtggagctatcagccccagatgggcctggccgcgggggccgcccaggactactccagcaagatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttttccggctcacctggacgctacccggacgccttcattcccaactttgacgcagtgagtgaatccgtggacggctacgactgatgacagatggtgcggccgtgagagctcggctgcgacatctgcatcactgccgccagcctcgctgctacgctcgggaggcgatcgtgttcagctactttgagctgccggacgagcaccctcaggggccggctcacgggttgaaactcgagatcgagaacgcgctcgagtctcgcctcatcgacgccttcaccgcccggcctctcctggtagaaaccgaacgcgggatcactaccatcaccctgttctgcatctgccccacgcccggattacatgaagatctgtgttgtcatctttgcgctcagtttaataaaaactgaactgtttgccgcaccttcaacgccatctgtgatttctacaacaaaaagttcttctggcaaaggtacacaaactgtattttattctaattctacctcatctattgtgctgaactgcgcctgcactaacgaacttatccgtagagggggctatcctctgtcactgtcacgcacctgattgcatgtccaaactaatcaaaactctctgtgctttaggtgatatttttaaaatgtaaatcataataaacttaccttaaatttgacaacaattttctggtgacatcattcagcagcaccactttaccctcttcccagctctcgtatgggatgcgatagtgggtggcaaacttcctccaaaccctaaaagaaatattggtatccacttccttgtcctcacccacaattttcatcttttcatagatgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtccgctccgcgtcacagacaacaaacttacatttaacttcacatcaccactccgttatgaaaatgaaaaccttacttttaactatacagagcctcttaaacttataaataacagccttgccattgacatcaattcctcaaaaggccttagtagcgtcggaggctcactagctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccgcttataaacaacgcctttagtattcgacagaatgacagtacggcctcaaaccctacctacaacgccctggcgtttatgcctaacagtaccatatatgcaagagggggaggtggtgaaccacgaaacaactactacgtccaaacgtatcttaggggaaatgttcaaaaaccaatcattcttactgtaacctacaactcagccgccacaggatattccttatcttttaagtggactgctcttgcacgtgaaaagtttgcaaccccaacaacttcgttttgctacattacagaacaataaaaccgtgtaccccaccgtttcgtttttttcagatgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacagttaaactaggaaacggcctcactctagacaaccagggacaactaacatcaaccgctggggaagtagaacctccactcactaacgctaacaacaaacttgcactggtctatagcgatcctttagcagtaaagcgcaacagcctaaccttatcgcacaccgctccccttgttattgctgataactctttagcattgcaagtttcagagcctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatagtggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcaatggaaacatagctgtttctcctcaagttacatcgcctgacaccttatggaccactgccgatccatcccccaattgttccatctacactgatttagatgccaaaatgtggctctcgttggtaaaacaagggggtgtggttcacggttctgttgctttaaaagcattgaaaggaaccctattgagtcctacggaaagtgccattgttattatactacattttgacaattatggagtgcgaattctcaattatcccactttgggcactcaaggcacgttgggaaataatgcaacttggggttataggcagggagaatctgcagacactaatgtactcaatgcactagcatttatgcccagttcaaaaaggtacccaagagggcgtggaagcgaagttcagaatcaaactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataaaacaacttttcctttttattttctttttattttacacgcacagtaaggcttcctccacccttccatttgacagcatacaccagagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctatgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagtgggaatatccaacgacagctgcaaagacagcaaaataatccctctgggagcaagcacaaaatcctccggtgaaaaaagaacatacatattagaataaccctgttgctggggcaaaaaggcccgacgtcccagcaaatgcacatatatgtgttgatcagccattgccccgtcttaccgcgtataaagccacgaaaaagtcgagctaaaatccacccaacagcctatagctatatatacactccgcccaatgacgctaacaccgtaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 233 - DNA, 37810 bp, Artificial Sequence
  Synthetic oligonucleotide pWe.RhAd56.pIX-rITR.dE3.5E4
gtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgtcaccgaggagctgaggacggaccaccacatgctgtcttgcctgcgtaccgactatgaatccagtgatgaggagtgaggtgaggggcggagccacaaagggtataaaggggcatgaagggtggacgcggtgtttcaaaatgagcgggacgacggacggcaatgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactatataaccaactggccactgcagctgtggcgtctcggtctctggttcaagaagatgccctgaatgtgatcttgactcgcctggagatcatgtcacgtcgcctggacgaactggctgcgcagatatcccaagctaaccccgataccgcttcagaatcttaaataaagacaaacaaatttgttgaaaagtaaaatggctttatttgttttttttggctcggtaggctcgggtccacctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggagagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggtggatttgatatttacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgattaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccggacagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggatgggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtgtcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgtagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttggatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcgaccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggatcccgcacttttggcatccatgcagagtcaaccttcgggcgtgaccgcctccgatgactgggcggcggccatggaccgcatcatggcgctgaccacccgcaaccccgaggcttttagacagcaaccccaggccaaccgtttttcggccatcttggaagcggtggtaccgtcgcgcaccaacccgacgcacgagaaagtcctgactatcgtaaacgccctggtagacagcaaggccatccgccgcgacgaggcgggcttgatttacaacgctctgctggaacgggtggcgcgctacaacagcactaacgttcagaccaatctggatcgtctcaccaccgacgtgaaggaggcgctggctcagaaggagcgctttctgagggacagcaatctgggctctctggtggcactcaacgccttcctgagcacgcagccggccaacgtgccccgcgggcaggaggactacgtgagctttatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgcgactcgtacctgggtcatctcatcactctgtaccgcgaggccatcggtcaggctcagattgacgagcatacatatcaggagatcactaacgtgagccgggccctgggtcaggaagataccggcagcctggaggccacgttgaactttttgctaaccaaccggaggcaaaaaataccctcccagttcacgttaagcgccgaggaggagaggattctgcgatacgtgcagcagtccgtgagtctgtacttgatgcgggagggcgccaccgcttccacggctttagacatgacagctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctttgggacgacgtgtccgacagcattttcacgccggacaatcgccgattccagaagaaggagggcggagacgagctccccctctccagcgtggaggcggcctctaggggagagagcccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattaccaaaacgatcacagcaactttctgactaccgtggtgcagaacaatgacttcaccccgacggaggcgggcacgcagaccattaactttgacgagcgttcccgctggggcggtcagctgaaaaccattctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtgaaatttgataccagaaacttccgactggggtgggatcccgtgaccaagctggtaatgccaggcgtgtacaccaacgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcagcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctaccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctctggccgaacggctgtagacgataccatagacgccgtgattgccgacgcccgccggtacaaccccggaccggtcgctagcgccgcctccaccgtggattccgtgatagacagtgtggtggccggcgccagggcatatgctcgccgcaagaggcggctgcatcggaaacgtcgccccaccgccgccatgctagcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgttacgtcagcttcaaccgccgtggaagccatggaaacgcaaaccgaaacccccgccgcggttggtacgaaagaagtggcgttgcaaaccgacccctggtacgaatttgccaccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgcagccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgagggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacgatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcctggaacccgcgtaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacaaccccatggagcgcaaccccaccatggatctgctcaccggagtgcccaacagcatgcttcacagcccccaggtcgcccccaccctgcgccgtaaccaggaacacctgtatcgctttctggggaaacactctgcctatttccgccgccaccggcagcgcatcgagcaggccacggcctttgaaagcatgagccaaagagtgtaatcaataaaaaccatttttatttaacatgatacgcgcttctggcgtttttattaaaaatcgaacggttcgagggaggggtcctcgtgcccgctgggaagggacacgttgcggtactggaaacgggcgctccaacgaaactcggggatcaccagccgcggcaggggcacgtcttctaggttctgcttccagaactgccgcaccagctgcagggctcccatgacgtcgggcgccgagatcttgaagtcgcagttagggccggagcccccgcggctgttgcggaacacggggttggcacactggaacaccagcacgctggggttgtaaatactggccagggccgttgggtcggtcacctccgacgcatccagatcctcggcattgctcagggcgaacggagtcagcttgcacatctgccgtccgatctggggcaccaggtcgggtttgttgaggcaatcgcagcgcagagggattaggatgcgacgctgcccgcgttgcatgatagggtaactcgccgccaggaactcctccatctgacggaaggccatctgggccttggtaccctcggtgaaaaatagcccacaggacttgctagaaaatacgttattgccgcagttgatgtcttccgcgcagcagcgtgcatcttcgttcttcagctgaaccacgttacgcccccagcggttctggaccaccttggctttcgtaggatgctccttcaacgcccgctgaccgttctcgctggtcacatccatttccaccacgtgctccttgcagaccatctccactccgtggaagcagaacaggacgccctcctgctgggtattgcgatgctcccaaacggcacatccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagccgctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttggaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcagccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaactctcggagaaaaaagctaaggcctcctctgccgcgaggaaaaactccgccgccgctgccgccgccaaggatccgccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcattgccagcatgagcaaggagattcccaccccttacatgtggagctatcagccccagatgggcctggccgcgggggccgcccaggactactccagcaagatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttttccggctcacctggacgctacccggacgccttcattcccaactttgacgcagtgagtgaatccgtggacggctacgactgatgacagatggtgcggccgtgagagctcggctgcgacatctgcatcactgccgccagcctcgctgctacgctcgggaggcgatcgtgttcagctactttgagctgccggacgagcaccctcaggggccggctcacgggttgaaactcgagatcgagaacgcgctcgagtctcgcctcatcgacgccttcaccgcccggcctctcctggtagaaaccgaacgcgggatcactaccatcaccctgttctgcatctgccccacgcccggattacatgaagatctgtgttgtcatctttgcgctcagtttaataaaaactgaactgtttgccgcaccttcaacgccatctgtgatttctacaacaaaaagttcttctggcaaaggtacacaaactgtattttattctaattctacctcatctattgtgctgaactgcgcctgcactaacgaacttatccgtagagggggctatcctctgtcactgtcacgcacctgattgcatgtccaaactaatcaaaactctctgtgctttaggtgatatttttaaaatgtaaatcataataaacttaccttaaatttgacaacaattttctggtgacatcattcagcagcaccactttaccctcttcccagctctcgtatgggatgcgatagtgggtggcaaacttcctccaaaccctaaaagaaatattggtatccacttccttgtcctcacccacaattttcatcttttcatagatgaaaagaaccagagttgatgaagacttcaaccccgtctacccctatgacaccacaaccactcctgcagttccctttatatcacccccctttgtaaacagcgatggtcttcaggaaaaccccccaggtgttttaagtctgcgaatagctaaacccctatatttcgacatggagagaaaactagccctttcacttggaagagggttgacaattaccgccgccggacaattagaaagtacgcagagcgtacaaaccaacccaccgttgataattaccaacaacaacacactgaccctacgtcattctccccccttaaacctaactgacaatagcttagtgctaggctactcgagtccgctccgcgtcacagacaacaaacttacatttaacttcacatcaccactccgttatgaaaatgaaaaccttacttttaactatacagagcctcttaaacttataaataacagccttgccattgacatcaattcctcaaaaggccttagtagcgtcggaggctcactagctgtaaacctgagttcagacttaaagtttgacagcaacggatccatagcttttggcatacaaaccctgtggaccgctccgacctcgactggcaactgcaccgtctacagcgagggcgattccctacttagtctctgtttaaccaaatgcggagctcacgtcttaggaagtgtaagtttaaccggtttaacaggaaccataacccaaatgactgatatttctgtcaccattcaatttacatttgacaacaatggtaagctactaagctctccgcttataaacaacgcctttagtattcgacagaatgacagtacggcctcaaaccctacctacaacgccctggcgtttatgcctaacagtaccatatatgcaagagggggaggtggtgaaccacgaaacaactactacgtccaaacgtatcttaggggaaatgttcaaaaaccaatcattcttactgtaacctacaactcagccgccacaggatattccttatcttttaagtggactgctcttgcacgtgaaaagtttgcaaccccaacaacttcgttttgctacattacagaacaataaaaccgtgtaccccaccgtttcgtttttttcagatgaaacgggcgagagttgatgaagacttcaacccagtgtacccttatgaccccccacatgctcccgttatgcccttcattactccaccttttacctcctcggatgggttgcaggaaaaaccacttggagtgttaagtttaaactacagagatcccattactacgcaaaatgggtctcttacagttaaactaggaaacggcctcactctagacaaccagggacaactaacatcaaccgctggggaagtagaacctccactcactaacgctaacaacaaacttgcactggtctatagcgatcctttagcagtaaagcgcaacagcctaaccttatcgcacaccgctccccttgttattgctgataactctttagcattgcaagtttcagagcctatttttataaatgacaaggacaaactagccctgcaaacagccgcgccccttgtaactaacgctggcacccttcgcttacaaagcgccgcccctttaggcattgcagaccaaaccctaaaactcctgtttaccaaccctttgtacttgcagaataactttctcacgttagccattgaacgaccccttgccattaccaatagtggaaagctggctctacagctctccccaccgctacaaacagcagacacaggcttgactttgcaaaccaacgtgccattaactgtaagcaacgggaccctaggcttagccataaagcgcccacttattgttcaggacaacaacttgtttttggacttcagagctcccctgcgtcttttcaacagcgaccccgtactagggcttaacttttacacccctcttgcagtgcgcgatgaggcgctcactgttaacacaggccgcggcctcacagtgagttacgatggtttaattttaaatcttggtaaggatcttcgctttgacaacaacaccgtttctgtcgctcttagtgctgctttgcctttacaatacactgatcagcttcgccttaacgtgggcgctgggctgcgttacaatccagtgagtaaaaaattggacgtgaaccccaatcaaaacaagggtttaacctgggaaaatgactacctcattgtaaagctaggaaatggattaggttttgatggcaatggaaacatagctgtttctcctcaagttacatcgcctgacaccttatggaccactgccgatccatcccccaattgttccatctacactgatttagatgccaaaatgtggctctcgttggtaaaacaagggggtgtggttcacggttctgttgctttaaaagcattgaaaggaaccctattgagtcctacggaaagtgccattgttattatactacattttgacaattatggagtgcgaattctcaattatcccactttgggcactcaaggcacgttgggaaataatgcaacttggggttataggcagggagaatctgcagacactaatgtactcaatgcactagcatttatgcccagttcaaaaaggtacccaagagggcgtggaagcgaagttcagaatcaaactgtgggctacacttgtatacagggtgacctttctatgcccgtaccgtaccaaatacagtacaactatggaccaactggctactcctttaaatttatttggagaactgtttcaagacaaccatttgacatcccatgctgttttttctcttacattacggaagaataaaacaacttttcctttttattttctttttatcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccattgccccgtcttaccgcgtataaagccacgaaaaagtcgagctaaaatccacccaacagcctatagctatatatacactccgcccaatgacgctaacaccgtaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 234 - DNA, 6164 bp, Artificial Sequence
  Synthetic oligonucleotide RhAdApt57.Empty
catcatcaataatataccttattctggaaacgtgccaatatgataatgagcggggaggagcgaggcggggccggggtgacgtgcggtgacgcggggtgacgcggggtggcgcgagggcggggcgggtgtgcggaggcgcttagtttttacgtatgcggaaggaggttttataccggaagttgggtaatttgggcgtatacttgtaagttttgtgtagtttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgccttatcaatgtaactttagccataccaagtttttactagaacctgacaccttctctcgagtgtgtttcaacggggtttttgacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcttaattaattcgaacccataatacccataatagctgtttgccatcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgatggcaaacagctattatgggtattatgggttcgaattaattaa

SEQ ID NO: 235 - DNA, 38292 bp, Artificial Sequence
  Synthetic oligonucleotide pWe.RhAd57.pIX-rITR.dE3
gacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatttcggcgctcaagttgtcagtttctacaaacgaggaggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggatttaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggctccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggccgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcaccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgcgccaggtgcagatggtacttgatttccaggggggtgttggaagaggcgtccacggcgtagaggaggccgtgtccgcgcggggccaccaccgtgccccgaggaggttttacctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcctgataggcgatctcggccatgaactgctccacttcttcctcgcggaggtcgccgtgacccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagtacggcctgttgaatctgcgtgagggtggtctggaagtcgtccaggtccacgaagcggtgataggcccccgtgttgatggtgtaggtgcagttggccatgacggaccagttgacgacttgcatgccgggttgggtgatctccgtgtacttgaggcgcgagtaggcgcgggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgtcgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgggagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcaacacagccgcgacaacgagacgttccgcgacgccatgttgaacatcgcggagcccgagggtcgctggctcttggacctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacacacgagaaagtcctgactatcgtgaacgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaacttgcaaggcatgtggggcgtcaaggccccggtgggcgatcgagccaccatctccagtctgctgacccccaacactcgcctgctgctgctcttgatcgcgccgttcaccaacagtagcactatcagccgtgactcgtacctgggtcatctcatcactctgtaccgcgaggccatcggtcaggctcagatcgacgagcatacatatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgcgtccgatagcattttcacgccggctaatcgccgattccagaagaaggagggcggagacgagctccccctctccagcgtggaggccgcctctaggggagagagcccctttcccagtctgtcttccgccagtagcggtcgggtcacgcgcccgcggttgccgggggagagcgactacctgaacgaccccttgctgcgaccggctaggaagaaaaatttccccaacaacggggtggaaagcttggtggataaaatgaatcgttggaagacctacgcccaggagcagagggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaagggcgttcgagtcgcctgtactaataaaaaagaagcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggattagaaagcgccgccccttccaagagggctttcagatcatgtatgaggacctggagggaggtaatatacccgccctactggacgtgtcaaagtatgaggacagcgtgaagaaggcggaagctcagggacgagaaattcggggcgacacatttgcggtggcaccccaagacctggtgatagagcctttgactaaagacagcaaaaacagaagctacaacattattaccggtactatggacaccaaatatcggagctggtttctggcttacaactacggggatcccgaaaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtctaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgccagcatggccagacccaggagagggaacgtgtactgggtgcgcgattctgtgacgggagtccgcgtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcagacctattaaggaagtggcccccggtcttggggtgcaaacggtggacattcaaatccccgtcaccaccgcttcaaccgccgtggaagccatggaaacgcaaacggaaacccctgccgcgatcggtaccagggaagtggcgttgcaaacggagccttggtacgaatacgcagcccctcggcgtcagaggcgttccgctcgttacggtcccgccaacgccatcatgccagaatatgcactgcatccgtctatcctgcccactcccggataccggggtgtgacgtatcgcccgtctggaacccgccgccgaacccgtcgccgccgccgctcccgtcgcgctctggcccccgtgtcggtgcggcgtgtgacccgccggggaaagacagtcgtcattcccaacccgcgttaccaccctagcatcctttaataactctgccgttttgcagatggctctgacttgccgcgtgcgccttcccgttccgcactatcgaggaagatctcgtcgtaggagaggcatgacgggcagtggtcgccggcgggctttgcgcaggcgcatgaaaggcggaattttacccgccctgatacccataattgccgccgccatcggtgccatacccggcgttgcttcagtggccttgcaagcagctcgtaataaataaacgaaggcttttgcacttatgacctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaactttcaagaaaaagtggtcaatggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggggagcaaggagcctccctcgtacgagcaagccttgaaagagggcgcctctccaccctcctacccgatgactaagccgatcgcacccatggctcgaccggtgtacggcaaggattacaagcccgtcacgctagagctccccccgccgccaccgccgccccccacgcgcccgaccgttccttccctgccggctccgtcggcggccgcggcgggacccgtgtccgcacccgtcgccgtgcctctgccagacgcccgcccagtggccgtggccgctgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccccaccgtggcccccacccacgatgtaaccacggaccgctcgcagaggctgaccctgcgctttgtgcccgtagaccgggaggacaccgcgtactcttacaaagtgcgctacacgctggccgtaggggacaaccgagtgctggacatggccagcacctacttcgacatccggggggtattggatcgcggtcccagtttcaagccctactccggcaccgcttacaactccttggcccccaagggcgcccctaacccttcagaatgggaagggtcagacaacaaaacacacgttagaggtcaagcgccctttattagcgatgaaattacaaaggagggcataaaagtaggcactgatactggaaaccccggacaggcaatttatgctaaaaaagcttaccagccggaaccccaggtgggagaaacacaatggaacagcgacgtgggaacaaacgacaaagcggcaggacgaattttaaagaaaacaacacccatggttccgtgctacgggtcttacgccaagcccacaaacgaagaaggggggcaggctacaaaccaacaagtagatttgcagtttttctcaacgggtagctccaatacaactcccaaagttgtgctgtattccgaagacgtttctcttgaaacgccagacacccacctggtgtttaaaccaacagttactgcgggcgtcacaaatgcagaagctttgttagcgcagcaagctgctccgaatcgtccaaactacattgcattcagagataacttcattggacttatgtactacaacagtacaggaaatatgggagtgctggccggtcaggcttcgcagttgaacgctgtagtggatttgcaagacagaaacactgaactgtcatatcagctaatgttggatgctttaggtgacagaagcaggtacttttcaatgtggaatcaagccgtggacagttatgaccctgatgtaagaattgtggaaaatcatggagtagaagacgaattacccaactattgttttccgctggggggcatggcagtcaccgatacctactcaggcataaaaccttcagataacggaggtacatttcaggcagataacactgttgcagatagagtagaaataggttcaggaaacatgttcgccatggaaatcaatttgcaagccaacctgtggcggggtttcttatactccaatatcggactgtacctcccagacacgctaaaactcacccccgacaacatcacgctcccagagaacaaaaacacctaccagtatatgaacggtcgagtcacgccccccgggctcgtggacacctacgttaacgtgggcgcgcgctggtcccccgatgtcatggacagtattaacccttttaatcaccaccgcaacgccggactccgctaccgttccatgctcctgggaaacggacgctacgtgcccttccacattcaggtgccccagaaattctttgcaattaaaaacctgctgctgctccccggttcctatacctacgagtggaacttccgcaaggacgtgaacatgattttgcaaagctcgctgggtaacgacctgcgagttgacggggccagcatacgcttcgacagcatcaacctgtatgctaactttttccccatggcccacaacacggcctccaccctggaagccatgctgcgcaacgacaccaacgaccaatcttttaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggaaccttctacctcaaccatactttcaaaaaggtgtcaatcatgttcgactcctcggtcagctggcccggcaacgaccgcctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtgatgtggaggatccccttctctagcaactttatgtcgatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcctaacagcatgcttcacagcccccaggtcgcccccaccctgcgccgtaaccaggaacacctgtatcgctttttggggaaacactctgcctactttcgccgccaccggcagcgcattgaacaggccacagcctttgaaagcatgaaccaaagagtgtaatcaataaaaaaaccattttattttaacatgacacgcgcttctggcgttttttattaaaaatcgaagggttcgagggaggtgtcttcgtgcccgctggggagggacacgttgcggtactggaaacgggcgctccaacgaaactcggggatcaccagccgcggcagaggcacgtcttccaggttctgcttccaaaactgccgcaccagctgcagggctcccatcacgtcgggcgccgatatcttgaagtcgcagttagggccggagctcccgcggctgttgcggaacacggggttggcacactggaacaccagcacgccggggttgtggatactggccagggccgtcgggtcggtcacctccgacgcatccagatcctcggcgttgctcagggcaaacggggtcagcttgcacatctgccgcccaatctggggtacgaggtcgcgcttgttgaggcagtcgcagcgcagagggatcaggatgcgtcgctgcccgcgttgcatgatagggtaactcgccgccaggaactcctccatttgacggaaggccatctgggctttgccgccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgtccgttctcgctggttacatccatttccaacacgtgctccttgcagaccatctccactccgtggaagcagaacaggacgccctcctgctgggtactgcgatgctcccatacggcgcatccggtgggctcccagctcttgtgttttacccccgcgtaggcttccatgtaagccatgaggaatctgcccatcagctcggtgaaggtcttctgattggtgaaggtcagcggcaggccgcggtgctcctcgtttaaccaagtttgacagatcttgcggtacacggctccctggtcgggcagaaacttaaaagcccctctgctctcgttgtccacgtggaacttctccatcaacatcaccatgacttccatgcccttctcccaggcagtcaccagcggcgcgctctcggggttcttcaccaacacggcggtagaggggccctcgccggccccgacgtccttcatggtcattctttgaaactccacggagccgtccgcgcgacgtactctgcgcaccggagggtagctgaagcccacctccaccacggtgccttcgccctcgctgtcggagacaatctccggggatggcggcggcgcgggtgtcgccttgcgagccttcttcttgggagggagcggaggcacctcctgctcgcgctcggggctcatctcccgcaagtagggggtaatggagcttccgggttgattctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcggccgataggaagctgacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccgcccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtttcctacatgggcatcctccacgagaaccggctggggcagagcgtgctgcactgcaccttgcagggcgaggcgcggcgggactacgtccgcgactgcgtctacctcttcctcacccttacctggcagaccgccatgggcgtctggcagcagtgcttggaagagagaaacctcaaagagcttgacaaactcctctgccgccagcggagggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctccttcgtcctggagcgctccgggatcttacccgccatgagctgcgcgctaccttctgactttgtccccctttcctaccgcgagtgccctcccccactgtggagccactgctacctcttccaactggccaactttctggcctaccactccgacctcatggaagacgtaagcggagaggggctgctggagtgccactgccgctgcaacctctgcaccccccacagatccctggcctgcaacaccgagctgctcagcgagacccaggtcataggtaccttcgagatccagggaccccaacagcaagagggtgcttccggcttgaagctcactccggcgctgtggacctcggcttacttacgcaaatttgtagccgaggactaccacgcccacaaaattcagttttacgaaaaccaatctcgaccaccgaaagcccccctcacggcctgcgtcatcacccagagcaagatcctggcccaattgcaatccatcaaccaagcgcgtcgagatttccttttgaaaaagggtcggggggtgtacctagacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcatcgtcagcatgagcaaggagattcccaccccctacatgtggagctatcagccgcagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcgcctggacgctacccggacgccttcattcccaactttgacgcagtgagtgaatccgtggacggctacgactgatgacagatggtgcggccgtgagagctcggttgcgacatctgcatcactgccgtcagcctcgctgctacgctcgggagccgatcgtcttcagctactttgagctgccggacgagcaccctcagggaccggctcacgggttgaaactcgagatcgagaacgcgctcgagtctcgcctcatcgacgccttcaccgcccgacctctcctggtagaaaccgaacgcgggatcactaccatcaccctgttctgcatctgccccacgcccggattacatgaagatctgtgctgtcatctttgcgctcagtttaataaaaactgaactttttgccgcaccttcaacgccatctgtgatttctacaacaaaaagttcttctggcaaaggtacacaaactgtattttattctaattctacctcatctatcgtgctgaactgcgcctgcactaacgaacttacggacctgtcgagggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagtccgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacagggataaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctaagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcaggtaacaaacaatagcctcgctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttgacagcgagccccaactgggcgtacactttaatccccctatcaccgtgcaacaaggaggtctggccttaaatacaggggatggtttgcaagtatatcttaacaaactaacgctaaacataggcagagacttgcaatatgaaaacggctcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgaatcagtccggtatttgggagttaagatccaaacagtctctttggtgatgaaacgtggatccgtgatggacacaaatccctgggacaggttctccaacgtttcggtaaaaaactgcgtgccaccctacaaaacaaacaggttcaggctctccacgggttatctccccgatcaaactcatacagggtaaaggtgcgatgatgttccactaaaccacgcaggtggcgctgtctgaacctctcggtgcgactcctgtgaggctggtaagaagttagattgtccagcagcctcacagcacgtatcatcagtctacgagtacgtctggcgcagcagcgcatttgaatctcactgagatttcggcaagaatcgcacaccatcacaatcaggttgttcataatcccatagctgaacacgctccagccaaagctcattcgctccaacagcgccaccgcgtgtccgtccaaccttactttaacataaatcaggtgtctgccgcgtacaaacatactacccgcatacagaacttcccggggcaaacccctgttcaccacctgcctgtaccagggaaacctcacatttatcagggagccatagatagccattttaaaccaattagctaacaccgccccaccagctctacactgaagagaaccgggagagttacaatgacagtgaataatccatctctcatagcccctgattacctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccggcgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcaatgcacacctcaaacctacagatgtctcggtacagttccaaacacgtagtgagggcgagttccaaccaagacagacaggctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccactgccaaagttcacccacacccacgaaacccgcgaaaatccagcgccgtcagcacttccgcaatttcagtctcacaacgtcacttccgcgcgccttttcacattcccacacccgcccacaaaccccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 236 - DNA, 6082 bp, Artificial Sequence
  Synthetic oligonucleotide RhAdApt58.Empty
taacatcatcaataatataccttattctggaagcgtgccaatatgataatgagcggggaggagcgaggcggggccggggtggggtgagggtgacgcgcggggcgggacggggcgaaggttgcgggcggggcggcggacgtgtgtggggaggcgcggaaagtttacgtaagcggaagtaggttttttaccggaagatgggtaatttgggcgtaatcttgtaacttttgtgtgatttggcgcgaaaactgggtaatgaggaagttgaggttaatatgtactttttatgactgggcggaatttttgcggatcagcactgaactttgggcgctgacgaggaggtttcgctacgtggcagtaccacgagaaggctcaaaggtcccatttattgtgctcctcagcgttttcgctgggtatttaaacgcgctcagatcatcaagaggccactcttgagtgccggcgagtagacctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatcctgacgtgtcagtggaaatttttaaagtgataagatatgatgaatgcaagtctcgttgtcgcccctgtgagtgtggagctaaccatatgaggttgtatcctgtaactctgaacgtcacggaagagctgagacctgatcatcacatgttgtcttgcttgcgcaccgactacgaatccagcgatgaggagtaaggtgaggggcggagttaaaaggggtataaataaacagggtgggcagacccctatattcaaaatgagcggcacaacagacggtaacgcgtttgaggggggagtattcagcccatatttgacatctcgtcttccttcctgggcaggagtgcgtcagaatgtagtgggctctaccgtggacggacggccggtcgcccctgcgaattccgccaccctcacctatgctaccgtgggatcatcgttggacactgccgcggcagctgctgcttctgctgccgcttctactgctcgtggcatggcggctgattttggactgtataaccaactggccactgcagctgtggcgtctcgctctctggtgcaagaagatgccctgaatgtgattctgactcgtctggagataatgtctcgtcgcttggacgaactggccgcgcaaatttcccaatccaatcccgaatcaacttcagaataaataaagacaaacagatttgatgaaataatggtgttttatttgttttttttggctcggtaggctcgggtccacctgtcccggtcgttaaggactttgtgtatattttccaagacccggtacagatgggcttggatgtttagatacatgggcatgaggccatctcgggggtggagataggaccattgcagagcgtcatgctccggggtggtgttgtagatgacccagtcgtagcagggtttttgggcgtggaactggaaaatgtccttgagaagcaggctgatggccaggggcaaacccttagtgtaggtgttcacaaagcggttgagctgggagggatgcatgcggggagagatgatatgcattttagcctggattttcaggttagctatgttgccccccaggtcccttcgtgggttcatattgtggaggaccaccagaacggtgtagccggtacacttggggaacttatcgtggagtttggaggggaacgcgtgaaagaatttggaaacccccttgtgcccacctaagttttccatgcactcatccatgataatggctatgggtcccctggcggccgctttggcaaacacattgtgggggttggaaacatcatagttttgctctagagttagctcatcataggccatttttacgaagcggggtagcagggtgccagactgagggacgatggttccatctggccccggggcgtaattaccctcacagatctgcatttcccaagctttaatttctgagggagggatcatgtccacctggggggcgatgaaaaacacggtttctggcgggggattgatgagctgggtggaaagcaggttgcgcaagagctgagacttgccgcaaccggtgggaccgtagatgaccccgatgacgggctgcagctggtaattgagagaggagcagctgccgtcggggcgtaggaggggagccacctcgttcatcatgcttcttacatgtttattttcactgactaagctttgcaagagcctctccccacccagggacaagagttcttccaggctgttaaagtgtttcagcggtttcaggccgtcggccatgggcatcttttcaagcgactgacgaagcaagtacaggcggtcccagagctcggtgacgtgctctatggaatctcgatccagcagacttcttggttgcgggggttgggccgactttcgctgtagggtacgagccggtgggcgtccagggccgccagggttctgtccttccagggtctcagcgtccgggttagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtaactgagggcctcggccgcgtgtcccttggcgcgcagctttcccttggaaacgtgctgacatttggtgcagtgcagacacttgagggcgtagagtttgggggccaggaaaacggactcgggtgagtaggcgtcggctccgcactgagcgcagacggtctcgcactccaccagccacgtgagctcgggtttagcgggattaaaaaccaagttgcctccattttttttgatgcgtttcttaccttgcgtctccataagtctgtgacccgcttccgtgacaaaaaggctgtcggtgtccccgtagaccgacttgatggggcgatcttccaagggcgttccgaggtcttccgcgtacaggaactgggaccactccgagacgaaggctctggtccacgctaacacgaaggaggcgatctgcgaggggtatctgtcgttttcaattaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaat

SEQ ID NO: 237 - DNA, 5892 bp, Artificial Sequence
  Synthetic oligonucleotide RhAdApt58.v2.Empty
taacatcatcaataatataccttattctggaagcgtgccaatatgataatgagcggggaggagcgaggcggggccggggtggggtgagggtgacgcgcggggcgggacggggcgaaggttgcgggcggggcggcggacgtgtgtggggaggcgcggaaagtttacgtaagcggaagtaggttttttaccggaagatgggtaatttgggcgtaatcttgtaacttttgtgtgatttggcgcgaaaactgggtaatgaggaagttgaggttaatatgtactttttatgactgggcggaatttttgcggatcagcactgaactttgggcgctgacgaggaggtttcgctacgtggcagtaccacgagaaggctcaaaggtcccatttattgtgctcctcagcgttttcgctgggtatttaaacgcgctcagatcatcaagaggccactcttgagtgccggcgagtagacctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccggtgaggggcggagttaaaaggggtataaataaacagggtgggcagacccctatattcaaaatgagcggcacaacagacggtaacgcgtttgaggggggagtattcagcccatatttgacatctcgtcttccttcctgggcaggagtgcgtcagaatgtagtgggctctaccgtggacggacggccggtcgcccctgcgaattccgccaccctcacctatgctaccgtgggatcatcgttggacactgccgcggcagctgctgcttctgctgccgcttctactgctcgtggcatggcggctgattttggactgtataaccaactggccactgcagctgtggcgtctcgctctctggtgcaagaagatgccctgaatgtgattctgactcgtctggagataatgtctcgtcgcttggacgaactggccgcgcaaatttcccaatccaatcccgaatcaacttcagaataaataaagacaaacagatttgatgaaataatggtgttttatttgttttttttggctcggtaggctcgggtccacctgtcccggtcgttaaggactttgtgtatattttccaagacccggtacagatgggcttggatgtttagatacatgggcatgaggccatctcgggggtggagataggaccattgcagagcgtcatgctccggggtggtgttgtagatgacccagtcgtagcagggtttttgggcgtggaactggaaaatgtccttgagaagcaggctgatggccaggggcaaacccttagtgtaggtgttcacaaagcggttgagctgggagggatgcatgcggggagagatgatatgcattttagcctggattttcaggttagctatgttgccccccaggtcccttcgtgggttcatattgtggaggaccaccagaacggtgtagccggtacacttggggaacttatcgtggagtttggaggggaacgcgtgaaagaatttggaaacccccttgtgcccacctaagttttccatgcactcatccatgataatggctatgggtcccctggcggccgctttggcaaacacattgtgggggttggaaacatcatagttttgctctagagttagctcatcataggccatttttacgaagcggggtagcagggtgccagactgagggacgatggttccatctggccccggggcgtaattaccctcacagatctgcatttcccaagctttaatttctgagggagggatcatgtccacctggggggcgatgaaaaacacggtttctggcgggggattgatgagctgggtggaaagcaggttgcgcaagagctgagacttgccgcaaccggtgggaccgtagatgaccccgatgacgggctgcagctggtaattgagagaggagcagctgccgtcggggcgtaggaggggagccacctcgttcatcatgcttcttacatgtttattttcactgactaagctttgcaagagcctctccccacccagggacaagagttcttccaggctgttaaagtgtttcagcggtttcaggccgtcggccatgggcatcttttcaagcgactgacgaagcaagtacaggcggtcccagagctcggtgacgtgctctatggaatctcgatccagcagacttcttggttgcgggggttgggccgactttcgctgtagggtacgagccggtgggcgtccagggccgccagggttctgtccttccagggtctcagcgtccgggttagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtaactgagggcctcggccgcgtgtcccttggcgcgcagctttcccttggaaacgtgctgacatttggtgcagtgcagacacttgagggcgtagagtttgggggccaggaaaacggactcgggtgagtaggcgtcggctccgcactgagcgcagacggtctcgcactccaccagccacgtgagctcgggtttagcgggattaaaaaccaagttgcctccattttttttgatgcgtttcttaccttgcgtctccataagtctgtgacccgcttccgtgacaaaaaggctgtcggtgtccccgtagaccgacttgatggggcgatcttccaagggcgttccgaggtcttccgcgtacaggaactgggaccactccgagacgaaggctctggtccacgctaacacgaaggaggcgatctgcgaggggtatctgtcgttttcaattaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaat

SEQ ID NO: 238 - DNA, 37591 bp, Artificial Sequence
  Synthetic oligonucleotide pWe.RhAd58.pIX-rITR.dE3
taatgacgtgtcagtggaaatttttaaagtgataagatatgatgaatgcaagtctcgttgtcgcccctgtgagtgtggagctaaccatatgaggttgtatcctgtaactctgaacgtcacggaagagctgagacctgatcatcacatgttgtcttgcttgcgcaccgactacgaatccagcgatgaggagtaaggtgaggggcggagttaaaaggggtataaataaacagggtgggcagacccctatattcaaaatgagcggcacaacagacggtaacgcgtttgaggggggagtattcagcccatatttgacatctcgtcttccttcctgggcaggagtgcgtcagaatgtagtgggctctaccgtggacggacggccggtcgcccctgcgaattccgccaccctcacctatgctaccgtgggatcatcgttggacactgccgcggcagctgctgcttctgctgccgcttctactgctcgtggcatggcggctgattttggactgtataaccaactggccactgcagctgtggcgtctcgctctctggtgcaagaagatgccctgaatgtgattctgactcgtctggagataatgtctcgtcgcttggacgaactggccgcgcaaatttcccaatccaatcccgaatcaacttcagaataaataaagacaaacagatttgatgaaataatggtgttttatttgttttttttggctcggtaggctcgggtccacctgtcccggtcgttaaggactttgtgtatattttccaagacccggtacagatgggcttggatgtttagatacatgggcatgaggccatctcgggggtggagataggaccattgcagagcgtcatgctccggggtggtgttgtagatgacccagtcgtagcagggtttttgggcgtggaactggaaaatgtccttgagaagcaggctgatggccaggggcaaacccttagtgtaggtgttcacaaagcggttgagctgggagggatgcatgcggggagagatgatatgcattttagcctggattttcaggttagctatgttgccccccaggtcccttcgtgggttcatattgtggaggaccaccagaacggtgtagccggtacacttggggaacttatcgtggagtttggaggggaacgcgtgaaagaatttggaaacccccttgtgcccacctaagttttccatgcactcatccatgataatggctatgggtcccctggcggccgctttggcaaacacattgtgggggttggaaacatcatagttttgctctagagttagctcatcataggccatttttacgaagcggggtagcagggtgccagactgagggacgatggttccatctggccccggggcgtaattaccctcacagatctgcatttcccaagctttaatttctgagggagggatcatgtccacctggggggcgatgaaaaacacggtttctggcgggggattgatgagctgggtggaaagcaggttgcgcaagagctgagacttgccgcaaccggtgggaccgtagatgaccccgatgacgggctgcagctggtaattgagagaggagcagctgccgtcggggcgtaggaggggagccacctcgttcatcatgcttcttacatgtttattttcactgactaagctttgcaagagcctctccccacccagggacaagagttcttccaggctgttaaagtgtttcagcggtttcaggccgtcggccatgggcatcttttcaagcgactgacgaagcaagtacaggcggtcccagagctcggtgacgtgctctatggaatctcgatccagcagacttcttggttgcgggggttgggccgactttcgctgtagggtacgagccggtgggcgtccagggccgccagggttctgtccttccagggtctcagcgtccgggttagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtaactgagggcctcggccgcgtgtcccttggcgcgcagctttcccttggaaacgtgctgacatttggtgcagtgcagacacttgagggcgtagagtttgggggccaggaaaacggactcgggtgagtaggcgtcggctccgcactgagcgcagacggtctcgcactccaccagccacgtgagctcgggtttagcgggattaaaaaccaagttgcctccattttttttgatgcgtttcttaccttgcgtctccataagtctgtgacccgcttccgtgacaaaaaggctgtcggtgtccccgtagaccgacttgatggggcgatcttccaagggcgttccgaggtcttccgcgtacaggaactgggaccactccgagacgaaggctctggtccacgctaacacgaaggaggcgatctgcgaggggtatctgtcgttttcaatgagggggtccaccttttccagggtgtgcagacagaggtcgtcctcctcggcatccacaaaggtgattggtttgtaagtgtaggtcacgtgaccggcaccccccgaaggggtataaaagggggcgtgcccaccctccccgtcactttcttccgcatcgctgtggaccagagccagctgttcgggtgagtaggccctctcaaaagccggcatgacttcggcactcaagttgtcagtttctacaaacgaggaggatttgatgttcacgtgccccgctgcgatgcttttgatagtggaggggtccatctggtcagaaaacacgatctttttgttgtcaagtttggtggcaaaagacccatagagggcgttggaaagcaacttggcgatggagcgcagggtctgatttttttcccgatcggccctctccttcgcggcgatgtttaattgcacatactcgcgggccacgcatcgccattccgggaacacggcggtgcgctcgtcggggaggatgcgcacgcgccagccgcggttgtgtagggtgatcaggtccacgctggtggccacctctcccctgaggggctcgttggtccaacacaatctccctccttttctggagcagaacggagggaggggatctaggaggttggggtgcggggggtcggcgtcgatggtgaagatgccgggcaggagcactttattaaagtaatcgatctcggtctccacgtcttgcaacgcttcctcccatctctttaccgccagggccctctcgtatggattcaggggcgccccccagggcatggggtgggtgagagccgaggcgtacatgccacagatgtcatacacgtacaggggctcccgtaggaccccgatgtaagtgggataacagcgccccccgcggatgctggcccgcacgtagtcgtacatctcgtgagacggggcgaggagaccctctcccaagtgggtcttgtggggcttctccgcccggtagaggatctgtctgaagatggcgtgggagttggaagagatggtaggccgttggaagacgttaaagttggcccgtggcagccccaccgagtcttcgatgaactgggcgtaggattcctggagtttgttcacgagggcggcggtgaccagcacgtccagggcgcagtagtccagggtctcgcggaccaggttgtaggagctctcttgttttttctcccacagttcgcggttgaggaggtattcctcgcggtctttccagtactcttcggcgggaaatcctttttcgtccgctcggtaagaacctaacatgtaaaactcgttcaccgctttgtatggacaacagcctttctctaccggcagggcgtacgcctgagcggcctttctgagagaagtgtgggtgagggcgaaggtgtcccgcaccatgactttcaggtactgatgcttgaagtccgtgtcgtcgcagcttccttgttcccacaagctgaagtcggtgcgctttttctgcctcgggttggggagggcgaaagtgacatcgttaaacaagattttcccggcgcggggcatgaagttgcgagagatcctgaagggcccgggcacgtccgagcggttgttgatgacctgcgccgccaggacgatctcgtcgaagccgttgatgttatgccccacgatgtagagttctatgaagcgcggctgtcccttgagggcgggcgcttttttcagttcctcgtaggtgagggattcgggagaggcgagccccagctccgcgcgggcccagtcggccagttgagggttagccgcgaggaaggaattccagagctccgaggccagaagagtttgcaggcggtcgcgaaactcgcggaactttttccccacggccattttttctggcgtgaccacgtagaaagtggcggagcggtcgttccagacgtcccacttgagctcccgggccagctcgcaagcctgacgcacgagagtttcctcgcccgaaacgtgcatgaccaacatgaaaggcactaactgttttccgaacgcgcccatccacgtgtaggtttctacatcgtaggtgacaaagagccgttgggtgcgtgcgtgggagccgatcggaaagaagctgatctcctgccaccagctggaggaatgggtgttgatgtggtgaaagtagaagtcccgccggcgcacagagcattcgtgctggtgtttgtaaaagcgaccgcagtagtcgcagcgctgcacgctctgtatctcttgaatgagatgcacttttcgcccgcgaaccagaaatcggaggggaaagttgagcccgggggatggtggagtcgcgtccccttcgccttggcggtgggcgtctgcgtctgcggcctgtttttctgggtggacgacggtggggacgacgacgccccgggttccgcaagtccagatttcagcgacggaggggcgcagacgctgaaggagggggcgcagttgcccgctgtccaaagagtcgaggaaagcgacgctgaggtcagcggggagcgtttgcaaattcactttcaagagaccggtaagagcgtgagtcaggtggagatggtacttgatttccaagggggtgttggcagaggcgtccacggcgtacaagagaccgtgtccgcgcggcgccaccacggttccccgcggaggttttatctcactcgtcgagggcgagcgccggggggtagaggcggctctgcgccgggaggtagcggaggcagaggcacgttttcgtgaggattcggcagcggctgatgacgtgcccggagactgctggcgtgggcgacgacgcggcggttgaggtcctggatgtgctgcctctgcgtgaagaccaccggccccctggtcctgaacctgaaagagagttccacagagtcaatgtctgcatcgttaacggccgcctgcctgaggatctcctgcacgtcgcccgagttgtcttggtaggcgatctcggccatgaactgttcgacttcttcttcgcggaggtcgccgtggcccgcgcgttctaccgtggcggccaggtcgttagagatgcgacgcatgagttgggagaaggcgttgaggccgttctcgttccacacgcggctgtacaccacgttaccgaaggagtcgcgcgctcgcatgaccacctgcgccacgttgagttccacgtggcgggcgaagacggcgtagtttctgaggcgctggaagaggtagttgagcgtggtggcgatgtgctcgcagacgaagaagtacatgatccagcgccgtagggtcatttcgttgatgtctccgatggcttcgagacgttccatggcctcgtagaagtcgacggcgaagttgaaaaattgggagttgcgggcggccaccgtgagttcttcttgcaggaggcggatgagatcggcgacggtgtcgcgcacctcctgttcgaaagcgccccgaggcgcctctgcttcttcctccagctcctcctcttccaagggcacaggttcctccggcacctctgcggcggggacggggcggcgacgtcgtcgtctgaccggcagtcggtccacgaagcgttcgatcatttcaccgcgccggcggcgcatggtctcggtgacggcgcgtccgttttcgcgaggacgcagttcgaagacgccgccgcgcagagcgcccccgtgcagggagggtaagtggttagggccgtcgggcagggacacggcgctgacgatgcattttatcaattgttgcgtaggcactccgtgcagggatctgagaacttcgaggtcgacgggatccgaaaacttctctaggaaagcgtctatccaatcgcaatcgcaaggtaagctgaggacggtggggcgctggggggcgtccgcgggtagttgggaggtgatgctgctgatgatgtaattaaagtaggcggtcttcaggcggcggatggtggcgaggaggaccacgtctttgggcccggcctgttgaatgcgcaggcgctcggccatcccccaggcctcgctctgacagcgacgcaggtctttgtagtagtcttgcatcagtctctccaccggaatctctgcttctcccctgtctgccatgcgagtcgagccgtacccccgcaagggctgcagcaacgctaggtctgccactactctttcggccagcacggcctgttgaatctgcgtgagggtggtctggaagtcgtccatatccacgaagcggtggtaggctcccgtgttaatggtgtaggtgcagttggccatgacggaccagttgacgacttgcatgccgggttgggtgatctccgtgtacttgaggcgcgagtaggccctggactcgaacacgtagtcgttgcatgcgcgcaccagatactggtagccgacgagaaagtggggaggcggttcccgatacaggggccagcccacggtggcgggggctccgggggccaggtcttccagcatgaggcggtggtagtggtacacgtatcgagagagccaggtgatgccggctgaggtggtggcggccctggtgaactcgcggacgcggttccagatgttgcgcagggggcggaagcgttccatggtgggcacgctctgtcccgtcaggcgcgcgcaatcctgtacgctctagatggaaaaaagacagggcggtcatcgactcccgtccgtagctgggaggtaaagtcgcaagggtgcagcggcggggaaccccggttcgagaccggccggatccgccgttcccgatgcgcctggccccgcatccacgacgttcgcgccgagacccagccgcggcacaccgccccaatacggaggggagtctttttggtgtttttttcatagatgcatccggtgctgcgacagatgcgaccccagacgcccgctgctactaccgccgcggcggcagtaaacctgagcggaggcggtgacagggaggacgaagagctggctttagacctggaagagggagagggactggcgagactgggcgccccctcccccgagagacaccccagggtccagctcgtgagggacgcgagacaggcttttgtgccgcggcagaacctgttcagagaccgcagcggccaggaggcggaggagatgcgcgattgtcggtttcgggcgggcaaagagctgagggcggggtttgaccgggagcggttgctgcgggcggaggatttcgaacccgacgagcgttcgggggtgagtccggctcgagcccacgtgtcggcggccaacctggtgagcgcgtacgagcagactgtgaacgaggagcgtaacttccaaaagagctttaataatcacgtgcggacccttatcgcgagggaagaggtgaccatcgggctgatgcatctgtgggacttcgtggaggcctacgtgcagaacccggcgagcaagcccctgacggctcagctgttcctgatcgtgcagcacagtcgcgataacgagacgtttcgcgacgccatgcttaacatcgccgagcccgagggccgctggctcttggatctcatcaacatcttgcagagcatcgtggttcaggagaggggtctcagcttagcggacaaggtggcggccattaactactccatgcagagtctgggaaaattctacgctcgcaagatctacaagagcccctacgtgcccatagacaaggaggtgaagatagacagcttttacatgcgcatggcgctgaaggtgctgacgctgagcgacgatctcggcgtgtaccgtaacgacaagatccacaaggcggtgagcgccagccgccggcgggagctgagcgacagggagctgatgcacagcttgcagagggcgctggcgggcgccggggacgaggatcgcgaggcttacttcgatatgggagcggacttgcagtggaaacccagcgcccgcgcgctggaggcggcgggctaccccggcgatgaggatcgggatgactttgaggaggcaggcgagtacgaggacgaagcctgaccgggcaggtgttgttttagatgcagcgtccggcggacggggccaccgtggatcccgcgcttttggcatccatgcagagtcaacctactggcgtgaccgcctccgatgactgggcggcggccatggaccgcatcatggcgctgaccacccgcaaccccgaggcttttaggcagcagccccaggccaaccgtttttcggccatcttggaagcggtggtgccctcgcgcactaatcccacccacgaaaaggtcttaacgatcgtgaacgcgctggtagacagcaaggccatccgccgcgacgaggcggggctgatttacaacgctctgctggaacgcgtggcgcgctacaacagcactaacgtgcagaccaatctggaccgcctcaccacggacgtgaaggaagcgttggctcagaaggagcggttcttgagggacagcaatctgggttctctggtggcgctgaatgctttcctgagcacgcagccggcgaacgtaccccgcgggcaggaggactacgtgagcttcatcagcgctctgagactgctagtctccgaggtgccgcagagcgaggtgtaccagtcgggtccggattacttcttccagacgtcccgccagggcttgcaaacggtgaacctgactcaggcttttaaaaacttgcaaggcatgtggggcgtgaaggcgccggtcggcgatcgcgcgaccatttccagcctcctgacccccaacacgagactgctgttgcttttaatcgccccgttcaccaacagcagcaccatcagccgcgactcgtacctgggtcatctcatcactctgtaccgagaggccataggacaggctcagattgacgagcatacgtatcaagagatcactaacgtgagccgagccctgggtcaggaagacaccggcagtttggaagccacgctaaactttttgctgaccaatcggaggcaaaagattccctcccagtacacgttaagcgccgaggaagagaggatcctgcgctacgtgcagcagtccgtgagcctgtacttgatgcgggagggggctaccgcttccacggccttggacatgacggctcgaaacatggaaccgtccttttactcggcccaccgtccgttcatcaatcgcctgatggactacttccatcgcgcggccgccatgaacggggagtattttaccaatgccatcttgaatccgcattggatgcctccgtccggtttctataccggggagttcgacctgcccgaggccgacgacggctttctgtgggacgacgtgtccgacagcatcttcacgcccgggaacagccggttccacaaaaaggaaggaggagacgaacttcccctttcgagtgtggaggcggcctccaggggggagagcccctttcctagcttgtcttccgtcagcagcggccgggtgacacgcccacgcttgccgggggagagcgactacttaaacgaccctttgctgcgaccggctagaaagaaaaattttcccaacaacggggtggaaagcttggtggataaaatgaatcgttggaagacctacgcccaggagcagcgggagtgggaggacagtcagccgcggccgctggtcccgccgcattggcgtcgccagagagaagacccggacgactccgcagacgatagtagcgtgttggacctgggagggagcggagccaacccctttgctcacttgcaacccaaggggcgcttgagtcgcctgtactaataaaaagaaagcggaaacgtaccagagccatggccacagcgtgtgtcctttcttcctctctttcctcctcggcgcggcagaatgagaagagcggtgagagtcacgccggcggtgtatgccgagggtccgcccccctcttacgaaagcgtgatgggatcagcgaacgtgccggccacgctggaggcgccttacgttcctcccagatacctgggacctaccgagggcagaaacagcatccgttactccgagctggcccccctgtacgataccaccaaggtgtacctggtggacaacaagtcggcggacatcgcctccctgaattaccaaaacgaccacagcaacttcctgaccaccgtggtgcagaacaatgacttcaccccgacggaggcgggcacgcagaccattaactttgacgagcgttcccgctggggcggtcagctgaaaaccatcctgcataccaacatgcccaacattaacgagtttatgtccaccaacaagtttagggccaggctgatggtagagaagactaacgctgagactcagcagcctcgatacgagtggtttgagttcaccattcccgagggcaactactccgaaaccatgactatcgatctgatgaataatgccattgtagacaattacctgcaagtcgggaggcagaacggggtgctggagagtgatattggggtaaaatttgataccaggaacttccggctggggtgggatccggtcactaagctggtgatgccaggcgtgtacaccaacgaggcttttcaccccgatatcgtgctgctgcctgggtgcggagtggactttacgcagagccgcttgagtaacctgttaggaatcaggaagcgccgcccctttcaggagggctttcagatcatgtatgaggacttggaaggaggtaacattcccgccctgctggacgtctcgaagtatgaagctagcgtacaacgcgctgaagcggaggggcgagagattcggggagacacctttgccgtggctccccaagacttggttatagagcctttaactaaagacagcaaaaacagaagctacaacattataaccggtaccacggatacccagtaccggagctggtttctggcttacaactacggggatcccgataaaggagtgagatcatggaccatactcaccacgacggacgtgacttgcggctcgcaacaagtgtactggtccctgccggatatgatgcaagacccggttaccttccgcccctccacccaagtcagcaacttcccggtggtgggcaccgagctgctgcccgttcacgccaagagcttttacaacgagcaggccgtgtactcccaactcattcgccagtccaccgcgcttacccacgtgtttaatcgcttccccgagaaccagattctcgtgcgccctcccgctcctactattaccaccgtgagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtagtggctcctaaagtgctctctagtcgcaccttctaaacatgtccattctcatctctcccgataacaataccggctggggtctgggatccggcaagatgtacggcggggcgaagcgacgctccagccaacaccccgttcgcgttcggggtcatttccgcgctccttggggtgcttacaagcgaggactctcgggtcgaacggcggtagacgataccatcgatgccgtgatcgccgacgcccgccggtacagccccggagcggtcgccagcaccgcctccaccgtggattccgtgattgacagcgtggtggccggcgcccgggcctatgctcgccgcaaaaagcggctgcaccgcaggcgccgacccacggcggcgatgctggccgcgagggccgtgctgaggcgggcccgcagggtaggcaggagggctatgcgtcgcgccgctgccaacgccgcagccgggagggcccgcaggcaagccgcccgtcaggccgccgccgccattgctagcatggccaggccgaggagagggaacgtgtactgggtgcgcgattctgtgacgggagtccgagtgccggtgcgcagccgacctccccgaagttagaagacgaaagctgcgaagacggcggtactgagtctccctgttgttgtcagcccaacatgagcaagcgcaagtttaaagaagaactcctgcaaaccttggtgcccgagatctatggccctccggacgagaagcctgacattaagccccgcgatatcaagcgcgttaaaaagcgggaaaaaaaagaggagctcgcggtggtagacgatggcggggtagaatttgttaggagtttcgccccgcggcgcagggtgcagtggaaagggcggcgcgttaagcgcgttttaagaccaggcaccgcggtagtttttaccccgggagagcggtcggccgtcaggggttttaagcggcagtacgacgaggtgtacggcgacgaagatattctggaacaggcggctcagcagattggagaattcgcctacggaaagcgctctcgtcaagaagacctggccatcgctttggacgatggcaatcccacgcccagcctcaagcccgtgacgctacagcaggtgctccccgtgagcgccagcgcggacagcaagaggggaattaagcgagagatggacgacctgcaacccaccatacaactcatggttcctaaacgacagaggctagaggaggtcctggagaagatgaaagtggatcctagcatccagcctgaggttaaagtgcggcctattaaagaagtggcccccggactcggggtgcaaacggtggacatccagatcccagttcgatccgcttcgacggccgtggaagccatggaaacgcaaaccgaaactccagttgcggtcggtaccagagaagtggctttgcagacggacccctggtacgaatacgccgctcctcggcgccagaggcgaaccggtcgttacggtccggcaagtgccatcatgccagagtacgcgttgcacccgtccatccagcccacccccggctaccggggggtgacgtatcgtccgtcggcaacccgccgccgctctcgtcgccgccgccgctcccgtcgccctctggcccccgtgtcggtgcggcgcgtaacccgccggggcaaaaccgtcaccatccctaacccgcgctaccaccctagcatcctttaataactctgccgttttgcagatggctctgacttgccgcgtgcgccttcccgttccgcactatcgaggaagatcccgtcgtaggagaggcatggcgggcagtggtcgccgccgggccttgcgcaggcgcatgaaaggcggaattttacccgcgctgattcccataattgccgccgccattggggcgatacctggcgttgcttcagtggccttgcaagcagctcgtaacaaataaacgaaggctttgcacttatgtcctggtcctgactattttatgcagaaagagcatggaagacatcaattttacgtcgctggctccgcggcacggctcgcggccgctcatgggcacctggaacgacatcggcaacagccagctcaacgggggcgctttcaattgggggagcatttggagcggcattaaaaactttggctccacgattaaaaccttcggcaacaaggcctggaacagtagtgctggtcagatgctccgggataaactgaaggacaccaactttcaagaaaaagttgttaatggggtagtaaccggcatacacggcgccgtggatctcgccaaccaagcggtgcagaaagagattgataggcgtttggaaaactccagggtgccgccgcagagaggggatgaaatggaggtggaggaagtagaagttgaggagaaactgcccccgctggaaaaagttcccggtgcgccaccgagaccgcagaaacggcctaggccagaactagaagaaactttagtgacggagagcaaagagcccccctcctacgagcaagctttgaaagagggcgcctctccatatcccatgactaaaccgatcgcacccatggcccgcccggtgtacggaaaggattccagacccgtgacgctagagctcccaccgccgccccctccgcgccccacagtacctccactgccagctccgtcggcgggtcccgtttctgcccctaccgcagcgcctcttccagccgcccgacccgtagccgtggccactgccagaaaccccagaggccagagaggagccaactggcaaagcacgctgaacagcatcgtgggcctgggagtgaaaagcctgaaacgccgccgttgctattattaaaaagtgtagctaaatttcccgttgtatacgcctcctatgttaccgccagagacgcgtgactggtcgccgctaccgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccccaccgtggcccccacccacgatgtaaccacggaccgctcgcagaggctgaccctgcgctttgtgcccgtagaccgggaggacaccgcgtactcttacaaagtgcgctacacgctggccgtaggggacaatcgagtgctggacatggccagtacctactttgacattcgaggggtgctggatcgcggccccagtttcaagccctactccggcaccgcttacaactccctggctcccaagggcgctcccaatcctgcagaatggacaaatactgacagcaaagtcaaagtgagggcgcaagcgccttttgttagctcttacggcgctacagcaattacaaaggagggcgttcaggtgggagtagtcttaacagactcgggatcgacaccacagtatgcggataaaacgtatcagcctgagccgcaaatcggcgagcagcagtggaacagcgatgttggaaccaatgacaaaatagcgggaagggtgttaaagaaaacaactcccatgttcccttgttacggctcatatgccagacccaccaacgaaaaaggagggcaggcgacaccgtccgctagtcaagacgtgcaaaatcccgaattacaatttttcgcctctactaatgtcgccaataccccaaaagcagtactatatgcagaggatgtggcaattgaagccccagacactcacttggtgttcaaaccaacagtaactgaaggaataacaagttcagaagctcttctgacccaacaagctgctcccaaccgaccaaactacatagcctttagagataattttattggtctgatgtactacaatagcactggcaacatgggagtgctagccggacaggcttctcagttgaatgccgttgttgacttgcaagacagaaatactgagctgtcttaccaactcatgttggacgccttgggagaccgcagtcggtacttctctatgtggaaccaagctgtagatagctatgatcctgacgtaagaataatagagaatcacggtgtggaagatgaattgcctaattactgcttccctttgggcggcatggcagtaactgacacctactcacccataaaggtcaatacagcagggaacggatgggaagccaataatgacgtttttaccgacagaggagttgaaataggttcaggcaatatgttcgccatggagattaacctgcaagccaacctgtggcgcagctttttgtattccaacatcgggctctatctcccagactctctgaaaatcacccccgacaacatcacactcccagagaacaagaacacctatcagtacatgaacggccgcgtaacaccacccgggctcgtagatacctacgtgaacgtgggagcgcgctggtcccccgatgtcatggacagcatcaaccccttcaaccaccatcgcaacgccgggctgcgctaccgctccatgctcctcggcaacggccgctatgtacccttccacattcaggtgccgcaaaagttttttgccattaagaacctgctgctgctccccggttcctatacctacgagtggaacttccgcaaggacgttaacatgatcttgcagagctcgctgggcaatgacctgcgtgtggacggggccagcatccgctttgacagtatcaacctctatgccaactttttccccatggcccacaacacggcttccaccctggaagccatgctgcgcaacgacaccaacgaccagtccttcaacgactacctgtgcgcggccaacatgctgtaccccatccccgccaacgccaccagcgtgcccatctctatcccctctcgcaactgggccgccttcaggggttggagtttcactcgcctcaaaaccaaggaaaccccctcgcttggctccggttttgatccctactttgtttactccgggagcattccctacctggatggcactttctacctcaaccacactttcaaaaaggtgtccatcatgtttgattcgtcggtgagttggcccggcaacgaccgcctgctaacgcccaacgaattcgaaatcaagcgttcggtggacggcgaagggtacaacgtggcccagagcaacatgacgaaggactggttcctcattcagatgcttagccattacaatattggctaccagggtttctacgtgcccgagaactacaaggatcgcatgtactccttttttagaaacttccaacccatgagccgccaaattgtagattccacgtcttacactaattaccaggatgtaaaactaccgtatcagcacaacaactcagggttcgtggggtatatggggcccactatgagagaagggcaggcttatccggccaattacccttaccccctaatcggcgccaccgctgtgcccagcttgacgcagaagaagttcctctgcgatagggttatgtggagaatccccttctctagcaactttatgtccatgggggccctcaccgatctggggcagaacatgctgtacgccaactccgcccacgccttggacatgacctttgagctggatcccatggatgagcccacacttctctatgttctgtttgaagtcttcgacgtggtgcgcattcaccagccgcaccgcggcgtcatcgaggccgtctacctgcgcacacctttctctgccggtaacgccaccacctaagaagctgatgggctccagcgaacaggagctacgggccattgttcgcgacctgggctgcgggccctactttttgggcaccttcgacaagcgcttccccggctttatgtccccccacaagccggcctgcgccatcgtgaacacggccgggcgggagaccgggggggttcactggcttgcctttgcctggaacccgcgtaaccgcacttgctacctgttcgacccttttggtttctccgacgaaaggcttaagcagatctaccaattcgaatacgaggggctcctgaagcgtagcgctctggcctccacgcccgaccactgcgttaccctggaaaagtccacccagacggtccaagggcccctttcggcagcctgcggccttttctgctgcatgtttttgcatgcttttgtccactggcccgacacccccatggaccgcaaccccaccatggatctgctcacgggagtgccaaacagcatgcttcacagcccccaggtcacccccaccctgcgccgcaatcaggaacagctgtatggttttttgggaaaacactctgcctatttccgccgccaccggcagcgtatagaacgggccacggcctttgaaagcatgagtcaaagagtgtaatcaataaaatcaacttttattttacacgatacgcgcttttggcgttttcttaaaaatcaaagggctcgagggaggggtcgtcgtgcccgctggggagggatacgttgcgatactggaatcgggagctccaacgaaactcgggaatgaccagccggggcaggaccacctcttccaggttctgcttccaaaactgccgcaccagctgtagggctcccatcacgtcgggcgccgagatcttgaagtcgcagttaggacccgagccaccgcggctgttgcgaaacacgggattggcgcactggaacaccagcacgctggggttgttgatgctggccagagccgtcggatctgtcacctccgaagcatccagatcctcggcgttgctcagggcaaacggggtcagcttgcacatctgccgcccaatctggggcaccaggtcgcgcttattgagacaatcgcaacggagaggaatcaggatgcgacgctgcccgcgttgcataataggatagctcgccgccaggaactcctccatctgacggaaggccatctgggccttagtgccctcggtgtaaaacagcccgcaggacttgctagagaacatgttattgccgcagttgatgtcttccgcgcagcagcgggcgtcttcgttctttagctgaaccacgttgcgcccccagcggttctggaccaccttagctttcgtaggatgctccttcagcgcccgctgcccgttctcgctggtcacatccatttccaccacgtgctccttgcagaccatctccactccgtggaagcagaacagaacgccttcctgctgagtattgcgatgctcccacacggcacacccggtgggctcccagctcttgtgtttcacccccgcgtaagcttccatgtaagccatgaggaatctgcccatcagctcggtgaaggtcttctggttggtgaaggtcagcggcaggccgcggtgctcctcgttcaaccacgtttgacagatcttgcggtacacggctccctgttcaggcagaaacttgaaagcccctctgctctcgttgtccacgtggaacttctccatcaacatcatcatggcttccatacccttctcccacgccgtcaccaggggcgcgctttcggggttcttcaccaacacggtggaagaaccctcgccggccctgatgtcgctcatgcttattttttgaaactcgacagtgccgtccgcgcgacgaactctgcgcaccggagggtagctgaaccccatctccatcacggcgccttcgccctcgctgtcggagacaatctccggggatggcggcggcgcgggggtggacttgcgagccttcttcttgggagggagcggcggcacttcctgttcgcgctcggggctcaactcccgcaagtagggggtgatagagcttccgggttgattctgacggttggccattgtctgatcctaggcagaaagacatggatcttatgggcgaggaaactttaaccgccccgtccccaatcgaagacgtcatcgtcgaacaggacccgggctacgttactccgcccgaggatctggaggggcctttagacgaccggcgcgacgctagtgagcagcaggaaaatgagaaagaggaagcatgctacctcctggaaggcgacattttgctaaagcatttcgccagacagagcaccatagtgaaggaggccttgcaagaccgctcggaggtgcccttggacgtcgccgcgctgtcccaggcctacgaggcgaacctcttctcgccccgggtgcctcccaaaagacagcccaacggcacctgcgagcccaacccgcgcctcaacttctaccccgtgtttgccgtacccgaggcactggccacctatcacatttttttcaagaaccagcgcatccccctctcgtgccgggccaaccgcaccgcggccgatagaaagctgaaacttaaaaacggagccgtcatacctgatatcacgtcgctagaggaagtgcccaagatcttcgagggtctgggtcgagacgagaaacgggcggcgaacgctctgcagagagaacagaaggacagtcagaacgtgctggtggaactggagggggacaatgcgcgtctggccgttctcaagcgctgcatagaagtttcccactttgcctaccctgccctgaacctgccgcccaaagtcatgcgctcggtcatggaccagctgctcatcaagagagctgagcccctgaaccccgagcatcccgaggcggagaactcggaggacggaaagcccgtcgtcagcgacgaggagctccagcggtggctggacaccacggaccccgagcagttgcaagagcggcgcaaaatgatgatggcggccgttctggtcaccgtcgagctggaatgcctgcagcggtttttcagcgacgtggaaacgctgcgcaaactcggagagtccctgcactacacctttcgccagggctacgtccgccaggcctgcaaaatctccaacgtggagctcagcaacctggtttcctacatgggcatcctgcacgaaaaccgcctggggcagagcgtgctgcactgcaccttgcaaggcgaggcgcggcgggactacgtgcgagactgcgtttacctcttcctcactctcacctggcagaccgccatgggagtgtggcagcagtgcttggaagatagaaacctcaaagagctagacaaacttctctgtcgccagcgtcgagccctctggtccggcttcagtgagcgcacggtggcctgcgcgctagcggacatcatcttccctgagcggctgatgaaaaccttacagaacggcttgccggatttcatcagccaaagcattttgcaaaactttcgctcttttgttttggaacgctccgggattttacccgctatgagttgcgcgctgccttctgacttcgtccctctctcctaccgcgagtgccctcccccgctgtggagccactgctaccttttccaactggccaactatctggcctaccactccgacctcatggaagacgtgaacggagaggggctgctggagtgccactgacgctgcaacctctgcaccccccaccgatcgctggcctgcaacaccgagctgctcagcgagacccaggttataggtaccttcgagatccaggggcccgcgcagcaagagggtgcttccggcttaaagctcactccggcgctgtggacctccgcttacttacgcaaatttgtatccgaggactaccacgcccacagaattcaattttacgaggaccaatctcgaccacccaaagcccccctcacggcctgcgtcattacccagagcaaaatcctggcccaattgcagtccattaaccaagcgcgccaagaattccttttgaaaaagggtcggggggtgtatctggacccccagaccggcgaggaactcaacccatccacgctctccgtcgaagcagccgctccgaaacatgccgcccaagggaaccgccaagcagctgatcgctcggcagagagcgaagaagcaggagctgcagcaggtggaagaggaagagctgtgggacagccaggcagaggaagtgtcagaggacgaggaggagatggaaagctgggacagcctagacgaggcggaggaggaggacgagctttcagaggaagaggcgaccgaagaaaaaccacctgcatccagcgcgccttctctgaaccgacagccgaagccccgacccccaacgcccccgcccggctcactcaaagccagccgtaggtgggacgccaccggatcttcagtagcggcggcagcgggtaaggccaaacgcgagcggcgggggtattgttcttggcgggcccacaaaagcagtattgtaaattgcttgcaacactgcgggggaaacatctcctttgcccgtcgctacctcctctttcaccacggtgtggccttccctcgcaacgttctctattattaccgtcatctctacagcccctacgaaacgctcggagaaaaaagctaaggccgccttctctgcgagaaaaaactccgccgccgccgccaccgccgccaaggactcgctagccgcccaggaactgcgaaagcgcatctttcccactctgtacgctatctttcagcaaagccgcgggcagcagccacagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgcttttccccctcggacgcccacgtcatcgccagcatgagcaaggagattcccaccccttacatgtggagctatcagccccagatgggcctggccgcgggggccgcccaagactactccagcaaaatgaactggctcagcgccggcccccacatgatctcacgagttaacggcatccgagcccaccgaaaccaaattctcttagaacaggcggcaatcaccgccacgccccggcgccaactgaacccgcccagttggcccgccgcccaggtgtatcaggaaactcccgccccgaccacagtcctcctgccacgcgacgcggaggccgaagtcctcatgactaactctggggtacaattagcgggcgggtccaggtacgccaggtacagaggtcgggccgctccttactctccggggagtataaagagggtgatcattcgaggccgaggtatccagctcaacgacgaggcggtgagctcctcaaccggtctcagacctgacggagttttccagctcggaggagcgggccgctcttccttcaccactcgccaggcctacctgaccctgcagagctcttcctcgcagcctcgctccgggggaatcggcactctccagttcgtggaggagttcgttccctccgtctacttcaacccgttctccggctcacccggacgctacccggacgccttcattcccaactttgacgcagtgagtgaatccgtggacggctacgactgatgacagatggtgcggccgtgagagctcggctgcgacatctgcatcactgccgccagccccgctgctacgctcgggaggcgtacgtgttcagctactttgagctgccggacgagcaccctcagggtccggctcacgggttgaaactcgaagttgagaaggagctcgagtctcgcctcattgacaccttcaccgcccgccctcttctggtggaaaaggagcacgggaccactaccatcactctgttctgcatctgccccacgcccggattacatgaagatttgtgttgtcatctttgtgctgaatttaataaatagctgttggacttcatctgaggacaactttgtgcccttcaaaggtaccatagacaccatatttttctctgactttaccacctcaattactttaaactgcacctgcactaacgaactaattcagtggcgagccaacagatgaccggtcctaccgaaggggctatcctttgccactgtcacgcgcctgattgtatgtccaaactaatcaaaaccctctgtgctttaggagatatattcaagtaacatgtaatcgcatcaataaacttaccttaaatctgacagcaattttttggtaacattgttcagcagcaccactttaccctcttcccagctctgatatgggatattacggtgggcggcaaatttcctccaaatcctaaacgaaacatggatgtccgcttccttatccttatccacaattttcatcttttcatagatgaaaagaactcgagttgacgaagacttcaatcctgtgtatccatatgatactacatctactccagccgttccttttatatcccctccctttgtaaacagtgatggtttacaggaaaacccacctggcatcttaagcctgcgaatagacagacccctttactttaacacacaaagacaattagcactttccctaggaaacgggttagcaatcaccgccgggggtgaactagaaagcacactgagcgttcgacccaatcccccattggttataaatggtaattcgctttcattgcgctactctgatcccctacgcgtggtgaatgacagcctaacatttaatttcacttcaccactccgttttgaaagcgggagtctcacatttcattacgcgtctccccttaaactaatgaatgacagtctcgctctcgacgtggagccttccaaaggtctcagcacagacggcaataaacttgctgttaagctcagctcagacctaaaatttgacaacaatggagctattgctttcggtatacagagtctatggacagctccaactacaactccaaactgcatgacatacgctgaaaatgactcactacttagtctctgtttaaccaaatgcggcgcccacgtactgggaagcgtaagtctcaccgggtttaccggagatctcttgaacatgaagcaaacaacagtgagtatcgaatttcgattcgataataatggcatattgacaacatctccactagtcaacagcagcagttggggcattagacaaaacaacggtatctacccgaaccctgtctacaatgcgctggcttttatgccaaacagcaccgtttactctcgagggggaggtggcgaaccccgaaacaactactacacccaaacataccttaggggcaatactcaaatacccattaccctcaccgtgacctacaactcagctaatacaggatattccttaacgtttaaatggactgcattaacaaaccaaaaatttgccgctccgactgcttccttttgctatatttcagaacaataaaacccgtttacccaaccgtttcgtttttttcagatgaaacgggtccgaatcgatgaagacttcaacccagtatacccttatgaccccccatacgctcccgttatgcccttcattactccgccttttacctcctcggatgggttgcaggaaaaaccacttggagtgttaagtttaaactacaaggatcccattactacacaaaatggatctctcacgttgaaaataggaaacggcctcactctagacaaccagggacaattaacatcaactgctggggaagtagagcctccgctcactaatgctaacaacaaacttgcactagcctatagcgaaccattagcagtgaaaagcaaccgcataactttatcacacaccgccccccttgtcgttgctgatgattctttagcgttgcaagtttcagaacctatttttatagatgacgatgacaagctagccctgcagacagccgccccccttgtaactaacgctggcacccttcgcttacagagcgccgcccctttaggattggttgaaaatactcttagactgctgttttctaaacccttgtatttgcaaaatgattttcttgcattagccattgaacgccccctggctatagcagccgcaggtactctagcactacaactcactcctccattaaagactaacgatgacgggctaacactatccacagtcgagccattaactgtaaaaaacggaaacctaggcttgcaaatatctcgccctttagttgttcaaaacagcagcctttcgcttgctattacccccccgctgcgtctatttaacagcgaccccgttcttggtttgggctttacttttcccctagctgtaacaaacaacctactctccttaaacatgggagacggtgttaaactaacctacaataaactaacagccaatttgggtagggatttacaatttgaaaacggtgccattgccgtaacgcttactgctgaattacctttgcaatacactaacaaacttcaactgaatattggagctggccttcgttacaatggagccagcagaaaactagatgtaaacattaaccaaaataagggcttaacttgggacaacgatgcagttattcccaaattaggatcaggtttacaattcgaccctaatggtaacatcgctgttatccctgaaaccgtaaagccgcaaacgttatggacaactgcagatccatcgcctaactgctcagtgtaccagaacttggacgccaggctgtggctcgctcttgttaaaagtggtgacatggttcatggaagcattgctctaaaagccctaaaaggaacgttgctaaatcctacagcaagctacatctccattgtgatatatttttacagcaacggagtccggcgtaccaactatcccacgtttgacaacgaaggcaccttagctaacagcgctacctggggataccgagaggggcaatctgctaacactaatgtaaccaatgccactgaatttatgcccagctcaaccaggtaccccgtgaataaaggagacaatattcagaatcaatctttttcatacacctgtatcaaaggagattttgctatgcctgtcccgttccgagtaacatataatcatgccctggaaggatactcccttaagttcacctggcgcgttgtagccaaccaagcttttgatattccttgctgttccttttcatacatcacagaataaaccactttttaaaatttttctttttattttacacgcacagtaaggcttcctccccccttccatctcacagcatacaccagcctctcccccttcatggcagtaaactgttgtgagtcagtccggtatttgggagttaagatccaaacagtctctttggtgatgaaacgtggatccgtgatggacacaaatccctggggcaggttctccaacgtttcggtgaaaaactgcgcgccgccctacaaaacaaacaggttcaggctctccacgggttatctccccgatcaaactcagacaaggtaaaggtgcgatgatattccactaaaccacgcaggtggcgctgtctgaacctctcggtgcgactcctgtgaggctgataggaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcaaacccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctgatagtctgatggaaatccagatctaacgtggcacaacagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagcccgtgcaagtactgaagcaactgtgcgggaatatgcacaacaaaaaaaatagggcggctcagatacatgttgacctaaaataaaaagaattattaaactaaagaagcttgacgaacggtgggataaatgacacgctccagcagcaaacaggcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagcgggaatatccaacgacagctgcaaagacagcaaaacaatccctttgggagcaatcacaaaatcctccggtgaaaaaagcacatacatattagaataaccctgttgctggggcaaaaaggcccgacgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccacgaccaaagttcacccacacccacaaaacccgcgaaaatccagcgccgtcagcacttccgcaatttcagtctcacaacgtcacttccgcgcgccttttcccattcccacacacacccgcccacaaacgccgccctcgcgccaccccgcgtcaccccacgtcaccgcacgtcaccccggccccgcctcgctcctccccgctcattatcatattggcacgcttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaat

SEQ ID NO: 239 - DNA, 37401 bp, Artificial Sequence
  Synthetic oligonucleotide pWe.RhAd58.v2.pIX-rITR.dE3
taaggtgaggggcggagttaaaaggggtataaataaacagggtgggcagacccctatattcaaaatgagcggcacaacagacggtaacgcgtttgaggggggagtattcagcccatatttgacatctcgtcttccttcctgggcaggagtgcgtcagaatgtagtgggctctaccgtggacggacggccggtcgcccctgcgaattccgccaccctcacctatgctaccgtgggatcatcgttggacactgccgcggcagctgctgcttctgctgccgcttctactgctcgtggcatggcggctgattttggactgtataaccaactggccactgcagctgtggcgtctcgctctctggtgcaagaagatgccctgaatgtgattctgactcgtctggagataatgtctcgtcgcttggacgaactggccgcgcaaatttcccaatccaatcccgaatcaacttcagaataaataaagacaaacagatttgatgaaataatggtgttttatttgttttttttggctcggtaggctcgggtccacctgtcccggtcgttaaggactttgtgtatattttccaagacccggtacagatgggcttggatgtttagatacatgggcatgaggccatctcgggggtggagataggaccattgcagagcgtcatgctccggggtggtgttgtagatgacccagtcgtagcagggtttttgggcgtggaactggaaaatgtccttgagaagcaggctgatggccaggggcaaacccttagtgtaggtgttcacaaagcggttgagctgggagggatgcatgcggggagagatgatatgcattttagcctggattttcaggttagctatgttgccccccaggtcccttcgtgggttcatattgtggaggaccaccagaacggtgtagccggtacacttggggaacttatcgtggagtttggaggggaacgcgtgaaagaatttggaaacccccttgtgcccacctaagttttccatgcactcatccatgataatggctatgggtcccctggcggccgctttggcaaacacattgtgggggttggaaacatcatagttttgctctagagttagctcatcataggccatttttacgaagcggggtagcagggtgccagactgagggacgatggttccatctggccccggggcgtaattaccctcacagatctgcatttcccaagctttaatttctgagggagggatcatgtccacctggggggcgatgaaaaacacggtttctggcgggggattgatgagctgggtggaaagcaggttgcgcaagagctgagacttgccgcaaccggtgggaccgtagatgaccccgatgacgggctgcagctggtaattgagagaggagcagctgccgtcggggcgtaggaggggagccacctcgttcatcatgcttcttacatgtttattttcactgactaagctttgcaagagcctctccccacccagggacaagagttcttccaggctgttaaagtgtttcagcggtttcaggccgtcggccatgggcatcttttcaagcgactgacgaagcaagtacaggcggtcccagagctcggtgacgtgctctatggaatctcgatccagcagacttcttggttgcgggggttgggccgactttcgctgtagggtacgagccggtgggcgtccagggccgccagggttctgtccttccagggtctcagcgtccgggttagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtaactgagggcctcggccgcgtgtcccttggcgcgcagctttcccttggaaacgtgctgacatttggtgcagtgcagacacttgagggcgtagagtttgggggccaggaaaacggactcgggtgagtaggcgtcggctccgcactgagcgcagacggtctcgcactccaccagccacgtgagctcgggtttagcgggattaaaaaccaagttgcctccattttttttgatgcgtttcttaccttgcgtctccataagtctgtgacccgcttccgtgacaaaaaggctgtcggtgtccccgtagaccgacttgatggggcgatcttccaagggcgttccgaggtcttccgcgtacaggaactgggaccactccgagacgaaggctctggtccacgctaacacgaaggaggcgatctgcgaggggtatctgtcgttttcaatgagggggtccaccttttccagggtgtgcagacagaggtcgtcctcctcggcatccacaaaggtgattggtttgtaagtgtaggtcacgtgaccggcaccccccgaaggggtataaaagggggcgtgcccaccctccccgtcactttcttccgcatcgctgtggaccagagccagctgttcgggtgagtaggccctctcaaaagccggcatgacttcggcactcaagttgtcagtttctacaaacgaggaggatttgatgttcacgtgccccgctgcgatgcttttgatagtggaggggtccatctggtcagaaaacacgatctttttgttgtcaagtttggtggcaaaagacccatagagggcgttggaaagcaacttggcgatggagcgcagggtctgatttttttcccgatcggccctctccttcgcggcgatgtttaattgcacatactcgcgggccacgcatcgccattccgggaacacggcggtgcgctcgtcggggaggatgcgcacgcgccagccgcggttgtgtagggtgatcaggtccacgctggtggccacctctcccctgaggggctcgttggtccaacacaatctccctccttttctggagcagaacggagggaggggatctaggaggttggggtgcggggggtcggcgtcgatggtgaagatgccgggcaggagcactttattaaagtaatcgatctcggtctccacgtcttgcaacgcttcctcccatctctttaccgccagggccctctcgtatggattcaggggcgccccccagggcatggggtgggtgagagccgaggcgtacatgccacagatgtcatacacgtacaggggctcccgtaggaccccgatgtaagtgggataacagcgccccccgcggatgctggcccgcacgtagtcgtacatctcgtgagacggggcgaggagaccctctcccaagtgggtcttgtggggcttctccgcccggtagaggatctgtctgaagatggcgtgggagttggaagagatggtaggccgttggaagacgttaaagttggcccgtggcagccccaccgagtcttcgatgaactgggcgtaggattcctggagtttgttcacgagggcggcggtgaccagcacgtccagggcgcagtagtccagggtctcgcggaccaggttgtaggagctctcttgttttttctcccacagttcgcggttgaggaggtattcctcgcggtctttccagtactcttcggcgggaaatcctttttcgtccgctcggtaagaacctaacatgtaaaactcgttcaccgctttgtatggacaacagcctttctctaccggcagggcgtacgcctgagcggcctttctgagagaagtgtgggtgagggcgaaggtgtcccgcaccatgactttcaggtactgatgcttgaagtccgtgtcgtcgcagcttccttgttcccacaagctgaagtcggtgcgctttttctgcctcgggttggggagggcgaaagtgacatcgttaaacaagattttcccggcgcggggcatgaagttgcgagagatcctgaagggcccgggcacgtccgagcggttgttgatgacctgcgccgccaggacgatctcgtcgaagccgttgatgttatgccccacgatgtagagttctatgaagcgcggctgtcccttgagggcgggcgcttttttcagttcctcgtaggtgagggattcgggagaggcgagccccagctccgcgcgggcccagtcggccagttgagggttagccgcgaggaaggaattccagagctccgaggccagaagagtttgcaggcggtcgcgaaactcgcggaactttttccccacggccattttttctggcgtgaccacgtagaaagtggcggagcggtcgttccagacgtcccacttgagctcccgggccagctcgcaagcctgacgcacgagagtttcctcgcccgaaacgtgcatgaccaacatgaaaggcactaactgttttccgaacgcgcccatccacgtgtaggtttctacatcgtaggtgacaaagagccgttgggtgcgtgcgtgggagccgatcggaaagaagctgatctcctgccaccagctggaggaatgggtgttgatgtggtgaaagtagaagtcccgccggcgcacagagcattcgtgctggtgtttgtaaaagcgaccgcagtagtcgcagcgctgcacgctctgtatctcttgaatgagatgcacttttcgcccgcgaaccagaaatcggaggggaaagttgagcccgggggatggtggagtcgcgtccccttcgccttggcggtgggcgtctgcgtctgcggcctgtttttctgggtggacgacggtggggacgacgacgccccgggttccgcaagtccagatttcagcgacggaggggcgcagacgctgaaggagggggcgcagttgcccgctgtccaaagagtcgaggaaagcgacgctgaggtcagcggggagcgtttgcaaattcactttcaagagaccggtaagagcgtgagtcaggtggagatggtacttgatttccaagggggtgttggcagaggcgtccacggcgtacaagagaccgtgtccgcgcggcgccaccacggttccccgcggaggttttatctcactcgtcgagggcgagcgccggggggtagaggcggctctgcgccgggaggtagcggaggcagaggcacgttttcgtgaggattcggcagcggctgatgacgtgcccggagactgctggcgtgggcgacgacgcggcggttgaggtcctggatgtgctgcctctgcgtgaagaccaccggccccctggtcctgaacctgaaagagagttccacagagtcaatgtctgcatcgttaacggccgcctgcctgaggatctcctgcacgtcgcccgagttgtcttggtaggcgatctcggccatgaactgttcgacttcttcttcgcggaggtcgccgtggcccgcgcgttctaccgtggcggccaggtcgttagagatgcgacgcatgagttgggagaaggcgttgaggccgttctcgttccacacgcggctgtacaccacgttaccgaaggagtcgcgcgctcgcatgaccacctgcgccacgttgagttccacgtggcgggcgaagacggcgtagtttctgaggcgctggaagaggtagttgagcgtggtggcgatgtgctcgcagacgaagaagtacatgatccagcgccgtagggtcatttcgttgatgtctccgatggcttcgagacgttccatggcctcgtagaagtcgacggcgaagttgaaaaattgggagttgcgggcggccaccgtgagttcttcttgcaggaggcggatgagatcggcgacggtgtcgcgcacctcctgttcgaaagcgccccgaggcgcctctgcttcttcctccagctcctcctcttccaagggcacaggttcctccggcacctctgcggcggggacggggcggcgacgtcgtcgtctgaccggcagtcggtccacgaagcgttcgatcatttcaccgcgccggcggcgcatggtctcggtgacggcgcgtccgttttcgcgaggacgcagttcgaagacgccgccgcgcagagcgcccccgtgcagggagggtaagtggttagggccgtcgggcagggacacggcgctgacgatgcattttatcaattgttgcgtaggcactccgtgcagggatctgagaacttcgaggtcgacgggatccgaaaacttctctaggaaagcgtctatccaatcgcaatcgcaaggtaagctgaggacggtggggcgctggggggcgtccgcgggtagttgggaggtgatgctgctgatgatgtaattaaagtaggcggtcttcaggcggcggatggtggcgaggaggaccacgtctttgggcccggcctgttgaatgcgcaggcgctcggccatcccccaggcctcgctctgacagcgacgcaggtctttgtagtagtcttgcatcagtctctccaccggaatctctgcttctcccctgtctgccatgcgagtcgagccgtacccccgcaagggctgcagcaacgctaggtctgccactactctttcggccagcacggcctgttgaatctgcgtgagggtggtctggaagtcgtccatatccacgaagcggtggtaggctcccgtgttaatggtgtaggtgcagttggccatgacggaccagttgacgacttgcatgccgggttgggtgatctccgtgtacttgaggcgcgagtaggccctggactcgaacacgtagtcgttgcatgcgcgcaccagatactggtagccgacgagaaagtggggaggcggttcccgatacaggggccagcccacggtggcgggggctccgggggccaggtcttccagcatgaggcggtggtagtggtacacgtatcgagagagccaggtgatgccggctgaggtggtggcggccctggtgaactcgcggacgcggttccagatgttgcgcagggggcggaagcgttccatggtgggcacgctctgtcccgtcaggcgcgcgcaatcctgtacgctctagatggaaaaaagacagggcggtcatcgactcccgtccgtagctgggaggtaaagtcgcaagggtgcagcggcggggaaccccggttcgagaccggccggatccgccgttcccgatgcgcctggccccgcatccacgacgttcgcgccgagacccagccgcggcacaccgccccaatacggaggggagtctttttggtgtttttttcatagatgcatccggtgctgcgacagatgcgaccccagacgcccgctgctactaccgccgcggcggcagtaaacctgagcggaggcggtgacagggaggacgaagagctggctttagacctggaagagggagagggactggcgagactgggcgccccctcccccgagagacaccccagggtccagctcgtgagggacgcgagacaggcttttgtgccgcggcagaacctgttcagagaccgcagcggccaggaggcggaggagatgcgcgattgtcggtttcgggcgggcaaagagctgagggcggggtttgaccgggagcggttgctgcgggcggaggatttcgaacccgacgagcgttcgggggtgagtccggctcgagcccacgtgtcggcggccaacctggtgagcgcgtacgagcagactgtgaacgaggagcgtaacttccaaaagagctttaataatcacgtgcggacccttatcgcgagggaagaggtgaccatcgggctgatgcatctgtgggacttcgtggaggcctacgtgcagaacccggcgagcaagcccctgacggctcagctgttcctgatcgtgcagcacagtcgcgataacgagacgtttcgcgacgccatgcttaacatcgccgagcccgagggccgctggctcttggatctcatcaacatcttgcagagcatcgtggttcaggagaggggtctcagcttagcggacaaggtggcggccattaactactccatgcagagtctgggaaaattctacgctcgcaagatctacaagagcccctacgtgcccatagacaaggaggtgaagatagacagcttttacatgcgcatggcgctgaaggtgctgacgctgagcgacgatctcggcgtgtaccgtaacgacaagatccacaaggcggtgagcgccagccgccggcgggagctgagcgacagggagctgatgcacagcttgcagagggcgctggcgggcgccggggacgaggatcgcgaggcttacttcgatatgggagcggacttgcagtggaaacccagcgcccgcgcgctggaggcggcgggctaccccggcgatgaggatcgggatgactttgaggaggcaggcgagtacgaggacgaagcctgaccgggcaggtgttgttttagatgcagcgtccggcggacggggccaccgtggatcccgcgcttttggcatccatgcagagtcaacctactggcgtgaccgcctccgatgactgggcggcggccatggaccgcatcatggcgctgaccacccgcaaccccgaggcttttaggcagcagccccaggccaaccgtttttcggccatcttggaagcggtggtgccctcgcgcactaatcccacccacgaaaaggtcttaacgatcgtgaacgcgctggtagacagcaaggccatccgccgcgacgaggcggggctgatttacaacgctctgctggaacgcgtggcgcgctacaacagcactaacgtgcagaccaatctggaccgcctcaccacggacgtgaaggaagcgttggctcagaaggagcggttcttgagggacagcaatctgggttctctggtggcgctgaatgctttcctgagcacgcagccggcgaacgtaccccgcgggcaggaggactacgtgagcttcatcagcgctctgagactgctagtctccgaggtgccgcagagcgaggtgtaccagtcgggtccggattacttcttccagacgtcccgccagggcttgcaaacggtgaacctgactcaggcttttaaaaacttgcaaggcatgtggggcgtgaaggcgccggtcggcgatcgcgcgaccatttccagcctcctgacccccaacacgagactgctgttgcttttaatcgccccgttcaccaacagcagcaccatcagccgcgactcgtacctgggtcatctcatcactctgtaccgagaggccataggacaggctcagattgacgagcatacgtatcaagagatcactaacgtgagccgagccctgggtcaggaagacaccggcagtttggaagccacgctaaactttttgctgaccaatcggaggcaaaagattccctcccagtacacgttaagcgccgaggaagagaggatcctgcgctacgtgcagcagtccgtgagcctgtacttgatgcgggagggggctaccgcttccacggccttggacatgacggctcgaaacatggaaccgtccttttactcggcccaccgtccgttcatcaatcgcctgatggactacttccatcgcgcggccgccatgaacggggagtattttaccaatgccatcttgaatccgcattggatgcctccgtccggtttctataccggggagttcgacctgcccgaggccgacgacggctttctgtgggacgacgtgtccgacagcatcttcacgcccgggaacagccggttccacaaaaaggaaggaggagacgaacttcccctttcgagtgtggaggcggcctccaggggggagagcccctttcctagcttgtcttccgtcagcagcggccgggtgacacgcccacgcttgccgggggagagcgactacttaaacgaccctttgctgcgaccggctagaaagaaaaattttcccaacaacggggtggaaagcttggtggataaaatgaatcgttggaagacctacgcccaggagcagcgggagtgggaggacagtcagccgcggccgctggtcccgccgcattggcgtcgccagagagaagacccggacgactccgcagacgatagtagcgtgttggacctgggagggagcggagccaacccctttgctcacttgcaacccaaggggcgcttgagtcgcctgtactaataaaaagaaagcggaaacgtaccagagccatggccacagcgtgtgtcctttcttcctctctttcctcctcggcgcggcagaatgagaagagcggtgagagtcacgccggcggtgtatgccgagggtccgcccccctcttacgaaagcgtgatgggatcagcgaacgtgccggccacgctggaggcgccttacgttcctcccagatacctgggacctaccgagggcagaaacagcatccgttactccgagctggcccccctgtacgataccaccaaggtgtacctggtggacaacaagtcggcggacatcgcctccctgaattaccaaaacgaccacagcaacttcctgaccaccgtggtgcagaacaatgacttcaccccgacggaggcgggcacgcagaccattaactttgacgagcgttcccgctggggcggtcagctgaaaaccatcctgcataccaacatgcccaacattaacgagtttatgtccaccaacaagtttagggccaggctgatggtagagaagactaacgctgagactcagcagcctcgatacgagtggtttgagttcaccattcccgagggcaactactccgaaaccatgactatcgatctgatgaataatgccattgtagacaattacctgcaagtcgggaggcagaacggggtgctggagagtgatattggggtaaaatttgataccaggaacttccggctggggtgggatccggtcactaagctggtgatgccaggcgtgtacaccaacgaggcttttcaccccgatatcgtgctgctgcctgggtgcggagtggactttacgcagagccgcttgagtaacctgttaggaatcaggaagcgccgcccctttcaggagggctttcagatcatgtatgaggacttggaaggaggtaacattcccgccctgctggacgtctcgaagtatgaagctagcgtacaacgcgctgaagcggaggggcgagagattcggggagacacctttgccgtggctccccaagacttggttatagagcctttaactaaagacagcaaaaacagaagctacaacattataaccggtaccacggatacccagtaccggagctggtttctggcttacaactacggggatcccgataaaggagtgagatcatggaccatactcaccacgacggacgtgacttgcggctcgcaacaagtgtactggtccctgccggatatgatgcaagacccggttaccttccgcccctccacccaagtcagcaacttcccggtggtgggcaccgagctgctgcccgttcacgccaagagcttttacaacgagcaggccgtgtactcccaactcattcgccagtccaccgcgcttacccacgtgtttaatcgcttccccgagaaccagattctcgtgcgccctcccgctcctactattaccaccgtgagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtagtggctcctaaagtgctctctagtcgcaccttctaaacatgtccattctcatctctcccgataacaataccggctggggtctgggatccggcaagatgtacggcggggcgaagcgacgctccagccaacaccccgttcgcgttcggggtcatttccgcgctccttggggtgcttacaagcgaggactctcgggtcgaacggcggtagacgataccatcgatgccgtgatcgccgacgcccgccggtacagccccggagcggtcgccagcaccgcctccaccgtggattccgtgattgacagcgtggtggccggcgcccgggcctatgctcgccgcaaaaagcggctgcaccgcaggcgccgacccacggcggcgatgctggccgcgagggccgtgctgaggcgggcccgcagggtaggcaggagggctatgcgtcgcgccgctgccaacgccgcagccgggagggcccgcaggcaagccgcccgtcaggccgccgccgccattgctagcatggccaggccgaggagagggaacgtgtactgggtgcgcgattctgtgacgggagtccgagtgccggtgcgcagccgacctccccgaagttagaagacgaaagctgcgaagacggcggtactgagtctccctgttgttgtcagcccaacatgagcaagcgcaagtttaaagaagaactcctgcaaaccttggtgcccgagatctatggccctccggacgagaagcctgacattaagccccgcgatatcaagcgcgttaaaaagcgggaaaaaaaagaggagctcgcggtggtagacgatggcggggtagaatttgttaggagtttcgccccgcggcgcagggtgcagtggaaagggcggcgcgttaagcgcgttttaagaccaggcaccgcggtagtttttaccccgggagagcggtcggccgtcaggggttttaagcggcagtacgacgaggtgtacggcgacgaagatattctggaacaggcggctcagcagattggagaattcgcctacggaaagcgctctcgtcaagaagacctggccatcgctttggacgatggcaatcccacgcccagcctcaagcccgtgacgctacagcaggtgctccccgtgagcgccagcgcggacagcaagaggggaattaagcgagagatggacgacctgcaacccaccatacaactcatggttcctaaacgacagaggctagaggaggtcctggagaagatgaaagtggatcctagcatccagcctgaggttaaagtgcggcctattaaagaagtggcccccggactcggggtgcaaacggtggacatccagatcccagttcgatccgcttcgacggccgtggaagccatggaaacgcaaaccgaaactccagttgcggtcggtaccagagaagtggctttgcagacggacccctggtacgaatacgccgctcctcggcgccagaggcgaaccggtcgttacggtccggcaagtgccatcatgccagagtacgcgttgcacccgtccatccagcccacccccggctaccggggggtgacgtatcgtccgtcggcaacccgccgccgctctcgtcgccgccgccgctcccgtcgccctctggcccccgtgtcggtgcggcgcgtaacccgccggggcaaaaccgtcaccatccctaacccgcgctaccaccctagcatcctttaataactctgccgttttgcagatggctctgacttgccgcgtgcgccttcccgttccgcactatcgaggaagatcccgtcgtaggagaggcatggcgggcagtggtcgccgccgggccttgcgcaggcgcatgaaaggcggaattttacccgcgctgattcccataattgccgccgccattggggcgatacctggcgttgcttcagtggccttgcaagcagctcgtaacaaataaacgaaggctttgcacttatgtcctggtcctgactattttatgcagaaagagcatggaagacatcaattttacgtcgctggctccgcggcacggctcgcggccgctcatgggcacctggaacgacatcggcaacagccagctcaacgggggcgctttcaattgggggagcatttggagcggcattaaaaactttggctccacgattaaaaccttcggcaacaaggcctggaacagtagtgctggtcagatgctccgggataaactgaaggacaccaactttcaagaaaaagttgttaatggggtagtaaccggcatacacggcgccgtggatctcgccaaccaagcggtgcagaaagagattgataggcgtttggaaaactccagggtgccgccgcagagaggggatgaaatggaggtggaggaagtagaagttgaggagaaactgcccccgctggaaaaagttcccggtgcgccaccgagaccgcagaaacggcctaggccagaactagaagaaactttagtgacggagagcaaagagcccccctcctacgagcaagctttgaaagagggcgcctctccatatcccatgactaaaccgatcgcacccatggcccgcccggtgtacggaaaggattccagacccgtgacgctagagctcccaccgccgccccctccgcgccccacagtacctccactgccagctccgtcggcgggtcccgtttctgcccctaccgcagcgcctcttccagccgcccgacccgtagccgtggccactgccagaaaccccagaggccagagaggagccaactggcaaagcacgctgaacagcatcgtgggcctgggagtgaaaagcctgaaacgccgccgttgctattattaaaaagtgtagctaaatttcccgttgtatacgcctcctatgttaccgccagagacgcgtgactggtcgccgctaccgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccccaccgtggcccccacccacgatgtaaccacggaccgctcgcagaggctgaccctgcgctttgtgcccgtagaccgggaggacaccgcgtactcttacaaagtgcgctacacgctggccgtaggggacaatcgagtgctggacatggccagtacctactttgacattcgaggggtgctggatcgcggccccagtttcaagccctactccggcaccgcttacaactccctggctcccaagggcgctcccaatcctgcagaatggacaaatactgacagcaaagtcaaagtgagggcgcaagcgccttttgttagctcttacggcgctacagcaattacaaaggagggcgttcaggtgggagtagtcttaacagactcgggatcgacaccacagtatgcggataaaacgtatcagcctgagccgcaaatcggcgagcagcagtggaacagcgatgttggaaccaatgacaaaatagcgggaagggtgttaaagaaaacaactcccatgttcccttgttacggctcatatgccagacccaccaacgaaaaaggagggcaggcgacaccgtccgctagtcaagacgtgcaaaatcccgaattacaatttttcgcctctactaatgtcgccaataccccaaaagcagtactatatgcagaggatgtggcaattgaagccccagacactcacttggtgttcaaaccaacagtaactgaaggaataacaagttcagaagctcttctgacccaacaagctgctcccaaccgaccaaactacatagcctttagagataattttattggtctgatgtactacaatagcactggcaacatgggagtgctagccggacaggcttctcagttgaatgccgttgttgacttgcaagacagaaatactgagctgtcttaccaactcatgttggacgccttgggagaccgcagtcggtacttctctatgtggaaccaagctgtagatagctatgatcctgacgtaagaataatagagaatcacggtgtggaagatgaattgcctaattactgcttccctttgggcggcatggcagtaactgacacctactcacccataaaggtcaatacagcagggaacggatgggaagccaataatgacgtttttaccgacagaggagttgaaataggttcaggcaatatgttcgccatggagattaacctgcaagccaacctgtggcgcagctttttgtattccaacatcgggctctatctcccagactctctgaaaatcacccccgacaacatcacactcccagagaacaagaacacctatcagtacatgaacggccgcgtaacaccacccgggctcgtagatacctacgtgaacgtgggagcgcgctggtcccccgatgtcatggacagcatcaaccccttcaaccaccatcgcaacgccgggctgcgctaccgctccatgctcctcggcaacggccgctatgtacccttccacattcaggtgccgcaaaagttttttgccattaagaacctgctgctgctccccggttcctatacctacgagtggaacttccgcaaggacgttaacatgatcttgcagagctcgctgggcaatgacctgcgtgtggacggggccagcatccgctttgacagtatcaacctctatgccaactttttccccatggcccacaacacggcttccaccctggaagccatgctgcgcaacgacaccaacgaccagtccttcaacgactacctgtgcgcggccaacatgctgtaccccatccccgccaacgccaccagcgtgcccatctctatcccctctcgcaactgggccgccttcaggggttggagtttcactcgcctcaaaaccaaggaaaccccctcgcttggctccggttttgatccctactttgtttactccgggagcattccctacctggatggcactttctacctcaaccacactttcaaaaaggtgtccatcatgtttgattcgtcggtgagttggcccggcaacgaccgcctgctaacgcccaacgaattcgaaatcaagcgttcggtggacggcgaagggtacaacgtggcccagagcaacatgacgaaggactggttcctcattcagatgcttagccattacaatattggctaccagggtttctacgtgcccgagaactacaaggatcgcatgtactccttttttagaaacttccaacccatgagccgccaaattgtagattccacgtcttacactaattaccaggatgtaaaactaccgtatcagcacaacaactcagggttcgtggggtatatggggcccactatgagagaagggcaggcttatccggccaattacccttaccccctaatcggcgccaccgctgtgcccagcttgacgcagaagaagttcctctgcgatagggttatgtggagaatccccttctctagcaactttatgtccatgggggccctcaccgatctggggcagaacatgctgtacgccaactccgcccacgccttggacatgacctttgagctggatcccatggatgagcccacacttctctatgttctgtttgaagtcttcgacgtggtgcgcattcaccagccgcaccgcggcgtcatcgaggccgtctacctgcgcacacctttctctgccggtaacgccaccacctaagaagctgatgggctccagcgaacaggagctacgggccattgttcgcgacctgggctgcgggccctactttttgggcaccttcgacaagcgcttccccggctttatgtccccccacaagccggcctgcgccatcgtgaacacggccgggcgggagaccgggggggttcactggcttgcctttgcctggaacccgcgtaaccgcacttgctacctgttcgacccttttggtttctccgacgaaaggcttaagcagatctaccaattcgaatacgaggggctcctgaagcgtagcgctctggcctccacgcccgaccactgcgttaccctggaaaagtccacccagacggtccaagggcccctttcggcagcctgcggccttttctgctgcatgtttttgcatgcttttgtccactggcccgacacccccatggaccgcaaccccaccatggatctgctcacgggagtgccaaacagcatgcttcacagcccccaggtcacccccaccctgcgccgcaatcaggaacagctgtatggttttttgggaaaacactctgcctatttccgccgccaccggcagcgtatagaacgggccacggcctttgaaagcatgagtcaaagagtgtaatcaataaaatcaacttttattttacacgatacgcgcttttggcgttttcttaaaaatcaaagggctcgagggaggggtcgtcgtgcccgctggggagggatacgttgcgatactggaatcgggagctccaacgaaactcgggaatgaccagccggggcaggaccacctcttccaggttctgcttccaaaactgccgcaccagctgtagggctcccatcacgtcgggcgccgagatcttgaagtcgcagttaggacccgagccaccgcggctgttgcgaaacacgggattggcgcactggaacaccagcacgctggggttgttgatgctggccagagccgtcggatctgtcacctccgaagcatccagatcctcggcgttgctcagggcaaacggggtcagcttgcacatctgccgcccaatctggggcaccaggtcgcgcttattgagacaatcgcaacggagaggaatcaggatgcgacgctgcccgcgttgcataataggatagctcgccgccaggaactcctccatctgacggaaggccatctgggccttagtgccctcggtgtaaaacagcccgcaggacttgctagagaacatgttattgccgcagttgatgtcttccgcgcagcagcgggcgtcttcgttctttagctgaaccacgttgcgcccccagcggttctggaccaccttagctttcgtaggatgctccttcagcgcccgctgcccgttctcgctggtcacatccatttccaccacgtgctccttgcagaccatctccactccgtggaagcagaacagaacgccttcctgctgagtattgcgatgctcccacacggcacacccggtgggctcccagctcttgtgtttcacccccgcgtaagcttccatgtaagccatgaggaatctgcccatcagctcggtgaaggtcttctggttggtgaaggtcagcggcaggccgcggtgctcctcgttcaaccacgtttgacagatcttgcggtacacggctccctgttcaggcagaaacttgaaagcccctctgctctcgttgtccacgtggaacttctccatcaacatcatcatggcttccatacccttctcccacgccgtcaccaggggcgcgctttcggggttcttcaccaacacggtggaagaaccctcgccggccctgatgtcgctcatgcttattttttgaaactcgacagtgccgtccgcgcgacgaactctgcgcaccggagggtagctgaaccccatctccatcacggcgccttcgccctcgctgtcggagacaatctccggggatggcggcggcgcgggggtggacttgcgagccttcttcttgggagggagcggcggcacttcctgttcgcgctcggggctcaactcccgcaagtagggggtgatagagcttccgggttgattctgacggttggccattgtctgatcctaggcagaaagacatggatcttatgggcgaggaaactttaaccgccccgtccccaatcgaagacgtcatcgtcgaacaggacccgggctacgttactccgcccgaggatctggaggggcctttagacgaccggcgcgacgctagtgagcagcaggaaaatgagaaagaggaagcatgctacctcctggaaggcgacattttgctaaagcatttcgccagacagagcaccatagtgaaggaggccttgcaagaccgctcggaggtgcccttggacgtcgccgcgctgtcccaggcctacgaggcgaacctcttctcgccccgggtgcctcccaaaagacagcccaacggcacctgcgagcccaacccgcgcctcaacttctaccccgtgtttgccgtacccgaggcactggccacctatcacatttttttcaagaaccagcgcatccccctctcgtgccgggccaaccgcaccgcggccgatagaaagctgaaacttaaaaacggagccgtcatacctgatatcacgtcgctagaggaagtgcccaagatcttcgagggtctgggtcgagacgagaaacgggcggcgaacgctctgcagagagaacagaaggacagtcagaacgtgctggtggaactggagggggacaatgcgcgtctggccgttctcaagcgctgcatagaagtttcccactttgcctaccctgccctgaacctgccgcccaaagtcatgcgctcggtcatggaccagctgctcatcaagagagctgagcccctgaaccccgagcatcccgaggcggagaactcggaggacggaaagcccgtcgtcagcgacgaggagctccagcggtggctggacaccacggaccccgagcagttgcaagagcggcgcaaaatgatgatggcggccgttctggtcaccgtcgagctggaatgcctgcagcggtttttcagcgacgtggaaacgctgcgcaaactcggagagtccctgcactacacctttcgccagggctacgtccgccaggcctgcaaaatctccaacgtggagctcagcaacctggtttcctacatgggcatcctgcacgaaaaccgcctggggcagagcgtgctgcactgcaccttgcaaggcgaggcgcggcgggactacgtgcgagactgcgtttacctcttcctcactctcacctggcagaccgccatgggagtgtggcagcagtgcttggaagatagaaacctcaaagagctagacaaacttctctgtcgccagcgtcgagccctctggtccggcttcagtgagcgcacggtggcctgcgcgctagcggacatcatcttccctgagcggctgatgaaaaccttacagaacggcttgccggatttcatcagccaaagcattttgcaaaactttcgctcttttgttttggaacgctccgggattttacccgctatgagttgcgcgctgccttctgacttcgtccctctctcctaccgcgagtgccctcccccgctgtggagccactgctaccttttccaactggccaactatctggcctaccactccgacctcatggaagacgtgaacggagaggggctgctggagtgccactgacgctgcaacctctgcaccccccaccgatcgctggcctgcaacaccgagctgctcagcgagacccaggttataggtaccttcgagatccaggggcccgcgcagcaagagggtgcttccggcttaaagctcactccggcgctgtggacctccgcttacttacgcaaatttgtatccgaggactaccacgcccacagaattcaattttacgaggaccaatctcgaccacccaaagcccccctcacggcctgcgtcattacccagagcaaaatcctggcccaattgcagtccattaaccaagcgcgccaagaattccttttgaaaaagggtcggggggtgtatctggacccccagaccggcgaggaactcaacccatccacgctctccgtcgaagcagccgctccgaaacatgccgcccaagggaaccgccaagcagctgatcgctcggcagagagcgaagaagcaggagctgcagcaggtggaagaggaagagctgtgggacagccaggcagaggaagtgtcagaggacgaggaggagatggaaagctgggacagcctagacgaggcggaggaggaggacgagctttcagaggaagaggcgaccgaagaaaaaccacctgcatccagcgcgccttctctgaaccgacagccgaagccccgacccccaacgcccccgcccggctcactcaaagccagccgtaggtgggacgccaccggatcttcagtagcggcggcagcgggtaaggccaaacgcgagcggcgggggtattgttcttggcgggcccacaaaagcagtattgtaaattgcttgcaacactgcgggggaaacatctcctttgcccgtcgctacctcctctttcaccacggtgtggccttccctcgcaacgttctctattattaccgtcatctctacagcccctacgaaacgctcggagaaaaaagctaaggccgccttctctgcgagaaaaaactccgccgccgccgccaccgccgccaaggactcgctagccgcccaggaactgcgaaagcgcatctttcccactctgtacgctatctttcagcaaagccgcgggcagcagccacagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgcttttccccctcggacgcccacgtcatcgccagcatgagcaaggagattcccaccccttacatgtggagctatcagccccagatgggcctggccgcgggggccgcccaagactactccagcaaaatgaactggctcagcgccggcccccacatgatctcacgagttaacggcatccgagcccaccgaaaccaaattctcttagaacaggcggcaatcaccgccacgccccggcgccaactgaacccgcccagttggcccgccgcccaggtgtatcaggaaactcccgccccgaccacagtcctcctgccacgcgacgcggaggccgaagtcctcatgactaactctggggtacaattagcgggcgggtccaggtacgccaggtacagaggtcgggccgctccttactctccggggagtataaagagggtgatcattcgaggccgaggtatccagctcaacgacgaggcggtgagctcctcaaccggtctcagacctgacggagttttccagctcggaggagcgggccgctcttccttcaccactcgccaggcctacctgaccctgcagagctcttcctcgcagcctcgctccgggggaatcggcactctccagttcgtggaggagttcgttccctccgtctacttcaacccgttctccggctcacccggacgctacccggacgccttcattcccaactttgacgcagtgagtgaatccgtggacggctacgactgatgacagatggtgcggccgtgagagctcggctgcgacatctgcatcactgccgccagccccgctgctacgctcgggaggcgtacgtgttcagctactttgagctgccggacgagcaccctcagggtccggctcacgggttgaaactcgaagttgagaaggagctcgagtctcgcctcattgacaccttcaccgcccgccctcttctggtggaaaaggagcacgggaccactaccatcactctgttctgcatctgccccacgcccggattacatgaagatttgtgttgtcatctttgtgctgaatttaataaatagctgttggacttcatctgaggacaactttgtgcccttcaaaggtaccatagacaccatatttttctctgactttaccacctcaattactttaaactgcacctgcactaacgaactaattcagtggcgagccaacagatgaccggtcctaccgaaggggctatcctttgccactgtcacgcgcctgattgtatgtccaaactaatcaaaaccctctgtgctttaggagatatattcaagtaacatgtaatcgcatcaataaacttaccttaaatctgacagcaattttttggtaacattgttcagcagcaccactttaccctcttcccagctctgatatgggatattacggtgggcggcaaatttcctccaaatcctaaacgaaacatggatgtccgcttccttatccttatccacaattttcatcttttcatagatgaaaagaactcgagttgacgaagacttcaatcctgtgtatccatatgatactacatctactccagccgttccttttatatcccctccctttgtaaacagtgatggtttacaggaaaacccacctggcatcttaagcctgcgaatagacagacccctttactttaacacacaaagacaattagcactttccctaggaaacgggttagcaatcaccgccgggggtgaactagaaagcacactgagcgttcgacccaatcccccattggttataaatggtaattcgctttcattgcgctactctgatcccctacgcgtggtgaatgacagcctaacatttaatttcacttcaccactccgttttgaaagcgggagtctcacatttcattacgcgtctccccttaaactaatgaatgacagtctcgctctcgacgtggagccttccaaaggtctcagcacagacggcaataaacttgctgttaagctcagctcagacctaaaatttgacaacaatggagctattgctttcggtatacagagtctatggacagctccaactacaactccaaactgcatgacatacgctgaaaatgactcactacttagtctctgtttaaccaaatgcggcgcccacgtactgggaagcgtaagtctcaccgggtttaccggagatctcttgaacatgaagcaaacaacagtgagtatcgaatttcgattcgataataatggcatattgacaacatctccactagtcaacagcagcagttggggcattagacaaaacaacggtatctacccgaaccctgtctacaatgcgctggcttttatgccaaacagcaccgtttactctcgagggggaggtggcgaaccccgaaacaactactacacccaaacataccttaggggcaatactcaaatacccattaccctcaccgtgacctacaactcagctaatacaggatattccttaacgtttaaatggactgcattaacaaaccaaaaatttgccgctccgactgcttccttttgctatatttcagaacaataaaacccgtttacccaaccgtttcgtttttttcagatgaaacgggtccgaatcgatgaagacttcaacccagtatacccttatgaccccccatacgctcccgttatgcccttcattactccgccttttacctcctcggatgggttgcaggaaaaaccacttggagtgttaagtttaaactacaaggatcccattactacacaaaatggatctctcacgttgaaaataggaaacggcctcactctagacaaccagggacaattaacatcaactgctggggaagtagagcctccgctcactaatgctaacaacaaacttgcactagcctatagcgaaccattagcagtgaaaagcaaccgcataactttatcacacaccgccccccttgtcgttgctgatgattctttagcgttgcaagtttcagaacctatttttatagatgacgatgacaagctagccctgcagacagccgccccccttgtaactaacgctggcacccttcgcttacagagcgccgcccctttaggattggttgaaaatactcttagactgctgttttctaaacccttgtatttgcaaaatgattttcttgcattagccattgaacgccccctggctatagcagccgcaggtactctagcactacaactcactcctccattaaagactaacgatgacgggctaacactatccacagtcgagccattaactgtaaaaaacggaaacctaggcttgcaaatatctcgccctttagttgttcaaaacagcagcctttcgcttgctattacccccccgctgcgtctatttaacagcgaccccgttcttggtttgggctttacttttcccctagctgtaacaaacaacctactctccttaaacatgggagacggtgttaaactaacctacaataaactaacagccaatttgggtagggatttacaatttgaaaacggtgccattgccgtaacgcttactgctgaattacctttgcaatacactaacaaacttcaactgaatattggagctggccttcgttacaatggagccagcagaaaactagatgtaaacattaaccaaaataagggcttaacttgggacaacgatgcagttattcccaaattaggatcaggtttacaattcgaccctaatggtaacatcgctgttatccctgaaaccgtaaagccgcaaacgttatggacaactgcagatccatcgcctaactgctcagtgtaccagaacttggacgccaggctgtggctcgctcttgttaaaagtggtgacatggttcatggaagcattgctctaaaagccctaaaaggaacgttgctaaatcctacagcaagctacatctccattgtgatatatttttacagcaacggagtccggcgtaccaactatcccacgtttgacaacgaaggcaccttagctaacagcgctacctggggataccgagaggggcaatctgctaacactaatgtaaccaatgccactgaatttatgcccagctcaaccaggtaccccgtgaataaaggagacaatattcagaatcaatctttttcatacacctgtatcaaaggagattttgctatgcctgtcccgttccgagtaacatataatcatgccctggaaggatactcccttaagttcacctggcgcgttgtagccaaccaagcttttgatattccttgctgttccttttcatacatcacagaataaaccactttttaaaatttttctttttattttacacgcacagtaaggcttcctccccccttccatctcacagcatacaccagcctctcccccttcatggcagtaaactgttgtgagtcagtccggtatttgggagttaagatccaaacagtctctttggtgatgaaacgtggatccgtgatggacacaaatccctggggcaggttctccaacgtttcggtgaaaaactgcgcgccgccctacaaaacaaacaggttcaggctctccacgggttatctccccgatcaaactcagacaaggtaaaggtgcgatgatattccactaaaccacgcaggtggcgctgtctgaacctctcggtgcgactcctgtgaggctgataggaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcaaacccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctgatagtctgatggaaatccagatctaacgtggcacaacagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcgatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagcccgtgcaagtactgaagcaactgtgcgggaatatgcacaacaaaaaaaatagggcggctcagatacatgttgacctaaaataaaaagaattattaaactaaagaagcttgacgaacggtgggataaatgacacgctccagcagcaaacaggcaaccggctgtccccgggaaccgcggtaaaattcatccgaatgattaaaaagaacaacagaaacttcccaccatgtactcggttggatctcctgagcacacagcaatacccccctcacattcatatccgccacagaaaaaaaacgtcccagatacccagcgggaatatccaacgacagctgcaaagacagcaaaacaatccctttgggagcaatcacaaaatcctccggtgaaaaaagcacatacatattagaataaccctgttgctggggcaaaaaggcccgacgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccacgaccaaagttcacccacacccacaaaacccgcgaaaatccagcgccgtcagcacttccgcaatttcagtctcacaacgtcacttccgcgcgccttttcccattcccacacacacccgcccacaaacgccgccctcgcgccaccccgcgtcaccccacgtcaccgcacgtcaccccggccccgcctcgctcctccccgctcattatcatattggcacgcttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaat

SEQ ID NO: 240 - DNA, 6083 bp, Artificial Sequence
  Synthetic oligonucleotide RhAdApt59.Empty
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgccttatcaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaacttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 241 - DNA, 5812 bp, Artificial Sequence
  Synthetic oligonucleotide RhAdApt59.v2.Empty
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaacttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 242 - DNA, 38355 bp, Artificial Sequence
  Synthetic oligonucleotide pWe.RhAd59.pIX-rITR.dE3
gccttatcaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacgaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccgaaggggtataaaagggggcgtgcccaccctccccgtcactttcttccgcatcgctgtggaccagagccagctgttcgggtgagtaggccctctcaaaagccggcatgatctcggcgctcaagttgtcagtttctacgaaagaggtggatttgatattcacgtgccccgcagcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcggacggggggtcggcgtcgatggtgaagatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatttcgtcgaagccgttaatgttgtggcccacgatgtaaagttccataaagcgcggctgtcccttgagggccggcgcttttttcaactcctcgtaggtgagacagtccggcgaggagagacccagctcagcccgggcccagtcggagagttgaggattagccgcgaggaaggaactccatagatccaaggccaggagagtttgcaagcggtcgcggaactcgcggaactttttgcccacggccattttctccggtgtcactacgtaaaaagtgtcggaccggtcgttccagacgtcccatcggagctctagggccagctcgcaggcttggtgaacgagggtttcctcgcccgagacgtgcatgaccagcataaagggtaccagttgtttcccgaacgagcccatccatgtgtaggtttctacgtcgtaggtgacaaagagccgctgggcgcgcgcgtgggagccgatcggaaagaagctgatctcctgccaccagctggaggaatgggtgttgatgtggtggaagtagaagccccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtttgcgtctgcgtccttcttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcctgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttaagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggctcgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccatgacggaccagttgacgacttgcatgccgggttgggtgatctccgtgtacttgaggcgcgagtaggcgcgggactcgaacacgtagtcgttgcatgtgcgcaccagatactggtagccgaccagaaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtgaacgccctggtagacagcaaggccatccgccgcgacgaggcggggctgatctacaacgctctgttggaacgggtggcgcgctacaacagcactaacgttcagaccaatctggatcgcctcaccaccgacgtgaaggaggcgctggctcagaaggagcggtttctgagggacagcaatctgggctctctggtggcactgaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgtcaaggccccggtgggcgatcgagccaccatctccagtctgctgacccccaacactcgcctgctgctgctcttgatcgcgccgttcaccaacagtagcactatcagccgtgactcgtacctgggtcatctcatcactctgtaccgcgaggccatcggtcaggctcagatcgacgagcatacgtatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctgaaaaccagcctcccgagtacgaatggtttgagttcaccattcccgagggcaactattccgagaccatgactatcgatctgatgaacaatgcgatcgtggacaattacctgcaagtggggaggcagaacggggtattggaaagcgatatcggtgtgaaatttgacaccagaaacttccgactggggtgggatcccgtgaccaagctggtgatgccaggcgtgtacaccaacgaggcttttcaccccgacatcgtgctgctgccggggtgcggcgtggatttcactcagagccgcttgagtaacctgttagggatcaggaagcgccgtcccttccaggagggctttcagatcatgtatgaggacctggagggaggcaacattccagggctgttagacgttcctgcttatgaggacagcgtgaaaaaggcggaagcccaaggacgggagatacggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctcgggccgaacggcggtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgccgccgccgggagggcccgccgtcaggctgcccgccaggccgccgctgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggttttaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaattaagagagaaatggaagatctgcatcccaccatccaactcatggtccctaaacggcagaggctggaagaggtcctggagaagatgaaagtggaccccagcatagagccggatgtaaaagtcagacctattaaggaagtggcccctggactcggggtgcagacggtggatatccagatccccgtcacgtcagcttcgaccgccgtggaagccatggaaacgcaaacggaaacccctgccgcgatcggtaccagggaagtggcgttgcaaacggagccttggtacgaatacgccgcccctcggcgtcagaggcgacccgctcgttacggccccgccaacgccatcatgccagaatatgcgctgcatccgtctatcctgcccacccccggctaccggggagtgacgtatcgcccgtctggaacccgccgccgaacccgtcgccgccgccgctcccgtcgcgctctggcccccgtgtcggtgcgccgcgtaacacgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggagagcaaggagcctccctcgtacgagcaagctttaaaagagggcgcctctccaccctcctacccgatgactaagccgatcgcacccatggctcgaccggtgtacgggaaggattacaagcccgtcacgctagagctccccccgccgccaccgccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggtgctccaaacccatcagagtggaacggaactgacagcaaaaccaatgtcagaggtcaagcaccattcattagtgatgcaataactaaagagggcataaaagttggtacagacacaggaaaccacggacaagcaatttatgctaaaaaagagtatcagcctgaaccccaagtgggggaaacgcaatggaatagcgacgttggagcaacagacaaagcggcaggacgaattttaaagaaaacgacacccatggttccgtgctatgggtcttatgccaaacccacaaacgaagaagggggtcaggctacaaaccagcaggtagatatgcagttttttgctaccggcagttctaatactacaccaaaggttgtgctgtactctgaagacgtgacgattgagacgcccgacacccacttagtatttaagccaattgtaacagcaggaaccacaaatgcagaagctttgttagcgcagcaagctgctcccaatcgaccaaactacattggctttagagataattttattggtcttatgtactacaacagcactggaaacatgggagtgctggctgggcaggcttcgcagttaaacgctgtggttgatttgcaagacagaaacactgagctatcttatcaactaatgctggatgctttgggggatagaagcagatacttttcaatgtggaatcaagcggtggacagttacgatcccgatgtgagaattgtagaaaaccacggagtagaggacgagttaccaaattactgtttcccgttaggcggtatggcagtaactgatacctacacaggtattaaacctgataatggaggcactacattctcaaatgatgacacttttgcaactagaggaatagaaataggttctggaaacatgttcgccatggagattaatctgcaggctaatctgtggcgtagtttcttgtattccaacatcgggctgtaccttccagacaccttgaaaatcactcccgacaacataacgttgccggacaacaaaaacacctaccagtacatgaatggtcgtgtcactccccccgggcttgtggacacctacgtgaacgtgggtgcgcgctggtcccccgacgtcatggacggcattaaccccttcaaccaccaccgcaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcagctaacatgctgtaccccatccccgccaatgccaccagcgtgcccatctctattccttctcggaactgggctgccttcaggggctggagttttactcgcctcaaaaccaaggagactccctcgctgggctccggttttgacccctactttgtttactccggctccattccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggttcctaattcaaatgctcagtcactataatataggttaccagggcttctatgtgcccgagaactacaaggaccgcatgtactccttcttccgcaacttccaaccaatgagccggcaggtggtagataccgtgacttatacagactacaaggatgtcaagctcccctaccaacacaacaactcagggttcgtgggctacatgggacccaccatgcgagaggggcaggcctacccggccaactatccttatcccctaatcggagagactgctgtacccagcctgacgcagaaaaagttcctctgcgaccgggtgatgtggaggatccccttctctagcaactttatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggagaccgggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttattttaacatgacacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccaaaactgccgcaccagctgcagggctcccatgacgtcgggcgccgatatcttgaagtcgcagttagggccggagctcccgcggctgttccggaacacggggttggcacactggaacaccatcacgctggggttgtggatactggccagggccgtcgggtcggtcacctccgacgcatccagatcctcggcgttgctcagggcaaacggggtcagcttgcacatctgccgcccgatctggggtactaggtcgcgcttgttgaggcagtcgcagcgcagagggatcaggatgcgtcgctgcccgcgttgcatgatagggtaactcgccgccaggaactcctccatttgacggaaggccgtctgggctttggcaccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgtccgttctcgctggttacatccatttctaacacgtgctccttgcagaccatctccactccgtggaagcagaacaggacgccctcctgctgggtactgcgatgctcccatacggcgcatccggtgggctcccagctcttgtgttttacccccgcgtaggcttccatgtaagccatgaggaatctgcccatcagctcggtgaaggtcttctgattggtgaaggtcagcggcaggccgcggtgctcctcgttcaaccaagtttgacagatcttgcggtacacggttccctggtcgggcagaaacttaaaagcccctctgctctcgttgtccacgtggaacttctccatcaacatcgtcatgacttccatgcccttctcccacgccgtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcggggctcatctcccgcaagtagggggtgatggagcttcccgcttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatattgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgatcgtgttcagctactttgagctgccggacgagcaccctcagggtccggctcacgggttgaaactcgagatcgagaacgcgctcgagtctcgcctcatcgacaccttcaccgcccgacctctcctggtagaaatccaacgggggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctccctatagaggtatcatacaaactgtttactttgacaactctactactctcctaaccctcaactgctcttgctctaaccggacctgtcgagggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctgagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcatgtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttaacagcgagccccaactgggcgtacactttaatccccctatcaccgtgcaacaaggcggtctggccttaaatacgggggatggtttgcaagtatatcttaacaaactaacgctaaacataggcagagacttgcaatatgaaaacgggtcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgagtcagtccggtatttgggagttaagatccaaacagtctctttggtaatcagatgtcgatccgtgatggacacaaatccctggggcaggttctccaacgtttcggtgaaaaactgcgtgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagctctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtataaagccacgaaaaagtcgagctaaaatccacccaacagcctatagctatatatacactccgcccaatgacgctaacaccgcaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccacgtcaccgcacgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 243 - DNA, 38084 bp, Artificial Sequence
  Synthetic oligonucleotide pWe.RhAd59.v2.pIX-rITR.dE3
ggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacgaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccgaaggggtataaaagggggcgtgcccaccctccccgtcactttcttccgcatcgctgtggaccagagccagctgttcgggtgagtaggccctctcaaaagccggcatgatctcggcgctcaagttgtcagtttctacgaaagaggtggatttgatattcacgtgccccgcagcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcggacggggggtcggcgtcgatggtgaagatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatttcgtcgaagccgttaatgttgtggcccacgatgtaaagttccataaagcgcggctgtcccttgagggccggcgcttttttcaactcctcgtaggtgagacagtccggcgaggagagacccagctcagcccgggcccagtcggagagttgaggattagccgcgaggaaggaactccatagatccaaggccaggagagtttgcaagcggtcgcggaactcgcggaactttttgcccacggccattttctccggtgtcactacgtaaaaagtgtcggaccggtcgttccagacgtcccatcggagctctagggccagctcgcaggcttggtgaacgagggtttcctcgcccgagacgtgcatgaccagcataaagggtaccagttgtttcccgaacgagcccatccatgtgtaggtttctacgtcgtaggtgacaaagagccgctgggcgcgcgcgtgggagccgatcggaaagaagctgatctcctgccaccagctggaggaatgggtgttgatgtggtggaagtagaagccccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtttgcgtctgcgtccttcttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcctgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttaagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggctcgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccatgacggaccagttgacgacttgcatgccgggttgggtgatctccgtgtacttgaggcgcgagtaggcgcgggactcgaacacgtagtcgttgcatgtgcgcaccagatactggtagccgaccagaaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtgaacgccctggtagacagcaaggccatccgccgcgacgaggcggggctgatctacaacgctctgttggaacgggtggcgcgctacaacagcactaacgttcagaccaatctggatcgcctcaccaccgacgtgaaggaggcgctggctcagaaggagcggtttctgagggacagcaatctgggctctctggtggcactgaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgtcaaggccccggtgggcgatcgagccaccatctccagtctgctgacccccaacactcgcctgctgctgctcttgatcgcgccgttcaccaacagtagcactatcagccgtgactcgtacctgggtcatctcatcactctgtaccgcgaggccatcggtcaggctcagatcgacgagcatacgtatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggctgaaaaccagcctcccgagtacgaatggtttgagttcaccattcccgagggcaactattccgagaccatgactatcgatctgatgaacaatgcgatcgtggacaattacctgcaagtggggaggcagaacggggtattggaaagcgatatcggtgtgaaatttgacaccagaaacttccgactggggtgggatcccgtgaccaagctggtgatgccaggcgtgtacaccaacgaggcttttcaccccgacatcgtgctgctgccggggtgcggcgtggatttcactcagagccgcttgagtaacctgttagggatcaggaagcgccgtcccttccaggagggctttcagatcatgtatgaggacctggagggaggcaacattccagggctgttagacgttcctgcttatgaggacagcgtgaaaaaggcggaagcccaaggacgggagatacggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctcgggccgaacggcggtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgccgccgccgggagggcccgccgtcaggctgcccgccaggccgccgctgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggttttaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaattaagagagaaatggaagatctgcatcccaccatccaactcatggtccctaaacggcagaggctggaagaggtcctggagaagatgaaagtggaccccagcatagagccggatgtaaaagtcagacctattaaggaagtggcccctggactcggggtgcagacggtggatatccagatccccgtcacgtcagcttcgaccgccgtggaagccatggaaacgcaaacggaaacccctgccgcgatcggtaccagggaagtggcgttgcaaacggagccttggtacgaatacgccgcccctcggcgtcagaggcgacccgctcgttacggccccgccaacgccatcatgccagaatatgcgctgcatccgtctatcctgcccacccccggctaccggggagtgacgtatcgcccgtctggaacccgccgccgaacccgtcgccgccgccgctcccgtcgcgctctggcccccgtgtcggtgcgccgcgtaacacgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggagagcaaggagcctccctcgtacgagcaagctttaaaagagggcgcctctccaccctcctacccgatgactaagccgatcgcacccatggctcgaccggtgtacgggaaggattacaagcccgtcacgctagagctccccccgccgccaccgccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggtgctccaaacccatcagagtggaacggaactgacagcaaaaccaatgtcagaggtcaagcaccattcattagtgatgcaataactaaagagggcataaaagttggtacagacacaggaaaccacggacaagcaatttatgctaaaaaagagtatcagcctgaaccccaagtgggggaaacgcaatggaatagcgacgttggagcaacagacaaagcggcaggacgaattttaaagaaaacgacacccatggttccgtgctatgggtcttatgccaaacccacaaacgaagaagggggtcaggctacaaaccagcaggtagatatgcagttttttgctaccggcagttctaatactacaccaaaggttgtgctgtactctgaagacgtgacgattgagacgcccgacacccacttagtatttaagccaattgtaacagcaggaaccacaaatgcagaagctttgttagcgcagcaagctgctcccaatcgaccaaactacattggctttagagataattttattggtcttatgtactacaacagcactggaaacatgggagtgctggctgggcaggcttcgcagttaaacgctgtggttgatttgcaagacagaaacactgagctatcttatcaactaatgctggatgctttgggggatagaagcagatacttttcaatgtggaatcaagcggtggacagttacgatcccgatgtgagaattgtagaaaaccacggagtagaggacgagttaccaaattactgtttcccgttaggcggtatggcagtaactgatacctacacaggtattaaacctgataatggaggcactacattctcaaatgatgacacttttgcaactagaggaatagaaataggttctggaaacatgttcgccatggagattaatctgcaggctaatctgtggcgtagtttcttgtattccaacatcgggctgtaccttccagacaccttgaaaatcactcccgacaacataacgttgccggacaacaaaaacacctaccagtacatgaatggtcgtgtcactccccccgggcttgtggacacctacgtgaacgtgggtgcgcgctggtcccccgacgtcatggacggcattaaccccttcaaccaccaccgcaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcagctaacatgctgtaccccatccccgccaatgccaccagcgtgcccatctctattccttctcggaactgggctgccttcaggggctggagttttactcgcctcaaaaccaaggagactccctcgctgggctccggttttgacccctactttgtttactccggctccattccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggttcctaattcaaatgctcagtcactataatataggttaccagggcttctatgtgcccgagaactacaaggaccgcatgtactccttcttccgcaacttccaaccaatgagccggcaggtggtagataccgtgacttatacagactacaaggatgtcaagctcccctaccaacacaacaactcagggttcgtgggctacatgggacccaccatgcgagaggggcaggcctacccggccaactatccttatcccctaatcggagagactgctgtacccagcctgacgcagaaaaagttcctctgcgaccgggtgatgtggaggatccccttctctagcaactttatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggagaccgggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttattttaacatgacacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccaaaactgccgcaccagctgcagggctcccatgacgtcgggcgccgatatcttgaagtcgcagttagggccggagctcccgcggctgttccggaacacggggttggcacactggaacaccatcacgctggggttgtggatactggccagggccgtcgggtcggtcacctccgacgcatccagatcctcggcgttgctcagggcaaacggggtcagcttgcacatctgccgcccgatctggggtactaggtcgcgcttgttgaggcagtcgcagcgcagagggatcaggatgcgtcgctgcccgcgttgcatgatagggtaactcgccgccaggaactcctccatttgacggaaggccgtctgggctttggcaccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgtccgttctcgctggttacatccatttctaacacgtgctccttgcagaccatctccactccgtggaagcagaacaggacgccctcctgctgggtactgcgatgctcccatacggcgcatccggtgggctcccagctcttgtgttttacccccgcgtaggcttccatgtaagccatgaggaatctgcccatcagctcggtgaaggtcttctgattggtgaaggtcagcggcaggccgcggtgctcctcgttcaaccaagtttgacagatcttgcggtacacggttccctggtcgggcagaaacttaaaagcccctctgctctcgttgtccacgtggaacttctccatcaacatcgtcatgacttccatgcccttctcccacgccgtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcggggctcatctcccgcaagtagggggtgatggagcttcccgcttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatattgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgatcgtgttcagctactttgagctgccggacgagcaccctcagggtccggctcacgggttgaaactcgagatcgagaacgcgctcgagtctcgcctcatcgacaccttcaccgcccgacctctcctggtagaaatccaacgggggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctccctatagaggtatcatacaaactgtttactttgacaactctactactctcctaaccctcaactgctcttgctctaaccggacctgtcgagggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttggggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctgagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcatgtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttaacagcgagccccaactgggcgtacactttaatccccctatcaccgtgcaacaaggcggtctggccttaaatacgggggatggtttgcaagtatatcttaacaaactaacgctaaacataggcagagacttgcaatatgaaaacgggtcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgagtcagtccggtatttgggagttaagatccaaacagtctctttggtaatcagatgtcgatccgtgatggacacaaatccctggggcaggttctccaacgtttcggtgaaaaactgcgtgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagctctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtataaagccacgaaaaagtcgagctaaaatccacccaacagcctatagctatatatacactccgcccaatgacgctaacaccgcaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccacgtcaccgcacgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 244 - DNA, 5715 bp, Artificial Sequence
  Synthetic oligonucleotide RhAdApt60.Empty
gactggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccaattctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagccacgaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaaatttgttgaaaataaacggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtgaaagaatttagagacccccttgtgtccccctaggttttccatgcactcatccataatgatggcaatgggacccctggcggccgctttggcaaacacgttttgggggttggaaacatcatagttttgctctagcgtgagctcatcataggccatcttaacaaagcggggtaggagggtgcccgactgggggatgatagttccatctgggcctggagcgtagttgccctcacagatctgcatctcccaggccttaatttccgaggggggtatcatgtccacctggggggcgataaagaacacggtttctggcggggggttgatgagctgggtggaaagcaagttacgcaacagctgggatttgccgcaaccggtgggaccgtagatgaccccgatgacgggttgcagctggtagttgagagaggagcagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctctgtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagtcccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttggttaattaattcgaacccataatacccataatagctgtttgccatcgaccaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgatggcaaacagctattatgggtattatgggttcgaattaattaacatcatcaataatataccttattctggaaacgtgccaatatgataatgagcggggaggagcgaggcggggccggggtgacgtgcggtgacgcggggtgacgcggggtggcgcgagggcggggcgggtgtggggaggcgcttagttttcacgtatgcggaaggaggttttataccggaagttgggtaatttgggcgtatacttgtaagttttgtgtaatttggcgcgaaaaccgggtaatgaggaagttgaggttaatatgtacgttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgtc

SEQ ID NO: 245 - DNA, 38465 bp, Artificial Sequence
  Synthetic oligonucleotide pWe.RhAd60.pIX-rITR.dE3
cgtgtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagccacgaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaaatttgttgaaaataaacggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtgaaagaatttagagacccccttgtgtccccctaggttttccatgcactcatccataatgatggcaatgggacccctggcggccgctttggcaaacacgttttgggggttggaaacatcatagttttgctctagcgtgagctcatcataggccatcttaacaaagcggggtaggagggtgcccgactgggggatgatagttccatctgggcctggagcgtagttgccctcacagatctgcatctcccaggccttaatttccgaggggggtatcatgtccacctggggggcgataaagaacacggtttctggcggggggttgatgagctgggtggaaagcaagttacgcaacagctgggatttgccgcaaccggtgggaccgtagatgaccccgatgacgggttgcagctggtagttgagagaggagcagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctctgtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagtcccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaaaaccgactcgggcgagtaggcgtcggccccgcactgagcgcagacggtttcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtgtccccgtacaccgacttgagggggcgatattccaaaggcgttccgaggtcttccgcgtacaggaactgggaccactccgagacgaaggctctggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgatccgcaccccccaaaggggtataaaagggggcgtgcccaccctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaagggtccatctgatcagaaaacacgatctttttattgtcaagtttggtggcgaaagacccgtagagggcgttggaaagcaacttggcgatggagcgcagggtctgatttttctcccgatcggccctctccttggcagcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccgggcagtcccacggagtcttggatgaactgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccacacatcccattggagctctagggccagctcgcaggcttggtgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttaagacgggggcttggtggggcggcatccctttcgccttggcggtgggagtctgcgtctgcgccctccttctctgggtggacgacggtggggacgacgacgccccgtgtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcaatcgtcgagggcgagcgccggggggtagaggcggctctgcgccggggggcagcggaggcagcggcacgttttcgtgaggatttggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaagaaagcgtctatccaatcgcagtcgcaaggtaagctgaggacagtgggtcgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggcgcgggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcccggacgcggttccagatgttgcgcaggggacggaagcgttccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcttacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgtgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacgcacgagaaagtcctgactatcgtgaatgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgtgactcgtacctgggtcatctcatcactttgtaccgcgaggccatcggtcaggctcagattgacgagcatacatatcaggagatcactaacgtgagccgggccctgggtcaggaagataccggcagcctggaagccacgttgaactttttgctaaccaaccggaggcaaaaaataccctcccagtttacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggcgagtttgacctgcccgaagccgacgacggctttctttgggacgacgtgtccgacagcattttcacgccgggcaatcgccgattccagaagaaggagggcggagacgagctccccctctccagcgtggaggcggcctctaggggagagagtccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaactcggcagccccgatacgagtggttcgagtttaccattccagagggcaactattccgaaactatgactatcgatctcatgaataacgcgatcgtggacaattacctgcaagtggggagacagaacggggtgctggaaagcgatatcggcgtgaaattcgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttaggaattagaaagcgccgcccattccaagagggctttcaaatcatgtatgaggacctggagggaggtaatatacccgccttactggacgtgtcgaagtacgaagctagcatacaacgcgccaaagcggagggtagagagattcggggagacacctttgcggtagctccccaggacctggaaatagtgcctttaactaaagacagcaaagacagaagctacaatattataaacaacacgacggacaccctgtatcggagctggtttctggcttacaactacggagaccccgagaaaggagtgagatcatggaccatactcaccaccacggacgtgacctgtggctcgcagcaagtgtactggtccctgccggatatgatgcaagacccggtcaccttccgcccctccacccaagtcagcaacttcccggtggtgggcaccgagctgctgcccgtccatgccaagagcttctacaacgagcaggccgtctactcgcaacttattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtggtggctcctaaagttctttctagtcgcaccttctaaaaacatgtccatcctcatctctcccgataacaacaccggctggggactgggctccggcaagatgtacggcggagccaaaaggcgctccagtcagcacccagttcgagttcggggccacttccgcgctccttggggagcttacaagcgaggactctcgggtcgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggcaggcagaagggctatgcgccgcgctgccgccaacgccgccgccgggagggcccgccgacaggctgcccgccaggctgctgctgccatcgctagcatggccagacccaggagagggaacgtgtactgggtgcgtgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagagggggattaagagagaaatggaagatctgcatcccaccatccaactcatggtccctaaacggcagaggctggaagaggtcctggagaagatgaaagtggaccccagcatagagccggatgtaaaagtcagacctattaaggaagtggcccccggtcttggggtgcaaacggtggacattcaaatccccgtcaccaccgcttcaaccgccgtggaagctatggaaacgcaaacggagacccctgccgcgatcggtaccagggaagtggcgttgcaaacggagccttggtacgaatacgcagcccctcggcgtcagaggcgttccgctcgttacggccccgccaacgccatcatgccagaatatgcgctgcatccgtctattctgcccactcccggataccggggtgtgacgtatcgcccgtctggaacccgccgccgaacccgtcgccgccgccgctcccgtcgcgctctggtccccgtgtcggtgcggcgtgtgacccgccggggaaagacagtcgtcattcccaacccgcgttaccaccctagcatcctttaataactctgccgttttgcagatggctctgacttgccgcgtgcgccttcccgttccgcactatcgaggaagatctcgtcgtaggagaggcatgacgggcagtggtcgccggcgggctttgcgcaggcgcatgaaaggcggaattttacccgccctgatacccataattgccgccgccatcggtgccatacccggcgttgcttcagtggcgttgcaagcagctcgtaataaataaacaaaggcttttgcacttatgacctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaatggggtggtgaccggcatccacggcgcggtagatctcgccaaccaagcggtgcagaaagagattgacaggcgtttggaaagctcgcgggtgccgccgcagagaggggatgaggtggaggtcgaggaagtagaagtagaggaaaagctgcccccgctggagaaagttcccggtgcgcctccgagaccgcagaagcggcccaggccagaactagaagagactctggtgacggagagcaaggagcctccctcgtacgagcaagccttgaaagagggcgcctctccaccctcctacccgatgactaagccgatcgcacccatggctcgaccggtgtacggcaaggattacaagcccgtcacgctagagctgcccccaccgccccccacgcgcccgaccgtcccccccctgccgactccgtcggcggccgcggcgggacccgtgtccgcaccatccgctgtgcctctgccagccgcccgtccagtggccgtggccactgtcagaaaccccagaggccagagaggagccaactggcaaagcacgctgaacagcatcgtgggcctgggagtgaaaagcctgaaacgccgccgttgctattattaaaaaagtgtagctaaaaagtctcccgttgtatacgcctcctatgttaccgccagagacgagtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggagctcccaacccctcggaatggacggacacttccgacaacaaacttaaagcatatgctcaggctccctaccagagtcaaggacttacaaaggatggtattcaggttgggctagttgtgacagagtcaggacaaacaccccaatatgcaaacaaagtgtaccaacccgagccacaaattggggaaaaccaatggaatttagaacaagaagataaagcggcgggaagagtcctaaagaaagatacccctatgtttccctgctatgggtcatatgccaggcccacaaacgaacaaggagggcaggcaaaaaaccaagaagtagatttacagttttttgccactccgggcgacacccagaacacggctaaagtggtactttatgctgaaaatgtcaacctggaaactccagatactcacttagtgtttaaacccgatgacgacagcaccagttcaaaacttcttcttgggcagcaggctgcacctaacagacccaactacataggttttagagataattttattggtttaatgtactacaatagcactggaaacatgggcgtgctggccggacaggcttctcaattgaatgccgtagtcgacttgcaggacagaaacaccgagttgtcctaccagctgatgctggacgcactgggggatcgcagccgatatttttcaatgtggaatcaggcagtagacagctatgacccagacgttagaattatagaaaaccacggagtggaagacgaactgccaaactattgttttcctctgggaggaatggtggtgactgacaattacaactctgtgacgcctcaaaatggaggcagtggaaatacatggcaggcagacaatactacatttagtcaaagaggagcgcagattggctccggaaacatgtttgccctggaaattaacctacaggccaacctctggcgcggcttcttgtattccaatattgggttgtatcttccagactctctgaaaatcacccccgacaacatcacgctgccagaaaacaaaaacacttatcagtacatgaacggtcgcgtaacgccacccgggctcatagacacctatgtaaacgtgggcgcgcgctggtcccccgatgtcatggacagcattaaccccttcaaccaccaccgtaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcggctaacatgctgtaccccatccccgccaacgccaccagcgtgcccatctctattccttctcggaactgggctgccttcaggggctggagttttactcgcctcaaaaccaaggagactccctcgctgggctccggttttgacccctactttgtttactccggctccattccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggtttctaattcaaatgctcagtcactataatataggttaccagggcttctatgtgcccgagaactacaaggaccgcatgtactccttcttccgcaacttccaaccaatgagccggcaggtggtagataccgtgacttatacagactacaaagatgtcaagctcccctaccaacacaacaactcagggttcgtgggctacatgggacccaccatgcgagagggacaggcctacccggccaactatccctaccccctgatcggagagactgccgtacccagcctcacgcagaaaaagttcctctgcgaccgggtgatgtggaggatacccttctctagcaactttatgtcgatgggctccctcaccgacctggggcagaacatgctgtacgccaactccgctcacgccttggacatgacttttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggttccagcgaacaggagttgcaggccattgttcgcgacctgggctgcgggccctgctttttgggcaccttcgacaagcgttttcccggattcatgtccccccacaagccggcctgcgccatcgttaacacggccggacgggagaccgggggggtgcactggctcgccttcgcctggaacccgcgcaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacacccccatggagcgcaaccccaccatggatctgctcaccggagtgcccaacagcatgcttcacagtccccaggtcgcccccaccctgcgccgcaatcaggaccacctgtatcgctttctggggaaacactctgcctatttccgccgccaccggcagcgcatcgaacaggccacggccttcgaaagcatgagccaaagagtgtaatcaataaaaaccgtttttatttgacatgatacgcgcttctggcgtttttattaaaaatcgaagggttcgagggaggggtcctcgtgcccgctggggagggacacgttgcggtactggaatcgggcgctccaacgaaactcggggattaccagccgcggcagggccacgtcttccatgttctgcttccaaaactgtcgcaccagctgcagggctcccatcacgtcgggcgctgagatcttgaagtcgcagttagggccggagcccccgcggctgttgcggaacacggggttggcacactggaacaccaacacgctggggttgtggatactagccagggccgtcgggtcggtcacctccgatgcatccagatcctcggcattgctcagggcgaacggggtcagcttgcacatctgccgcccgatctggggtaccaggtcgcgcttgttgaggcagtcgcagcgcagagggatgaggatgcgacgctgcccgcgttgcatgatggggtaactcgccgccaggaactcctctatctgacggaaggccatctgggccttgacgccctcggtgaaaaatagcccacaggacttgctggaaaacacgttattgccacagttgatgtcttccgcgcagcagcgcgcatcttcgttcttcagctgaaccacgttgcgaccccagcggttctgaaccaccttggcttttgtgggatgctccttcagcgcccgctgtccgttctcgctggtcacatccatttccaccacgtgctccttgcagaccatctccactccgtggaaacagaacagaatgcccgcctgttgggtattgcgatgctcccacacggcgcacccggtggactcccagctcttgtgtttcacccccgcgtaggcttccatgtaagccattagaaatctgcccatcagctcagtgaaggtcttctggttggtgaaggttagcggcaggccgcggtgttcctcgttcaaccaagtttgacagattttgcggtacacggctccctggtcgggcagaaacttaaaagtcgttctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggacattttttgaaactccacggtgccgtccgcgcggcgtactctgcgcatcggagggtagctgaagcccacctccatgacggtgccttcgccctcgctgtcggagacgatctccggggagggcggcggaacgggggcagacttgcgagccttcttcttgggagggagcggaggcacctcctgctcgcgctcgggactcatctcccgcaagtagggggtgatggagcttcctggttggttctgacggttggccattgtatcctaggcagaaagacatggagcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcggccgataggaagctaacactcagaaacggagtcagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctgaccgtcctcaaacgttgcatagaagtttcccacttcgcctacccggccctcaacctgccgcccaaagttatgaaatcggtcatggaccagctactcatcaagagagctgagcccctgaatcccgaccaccctgaggcggaaaactcagaggacggaaagcccgtcgtcagcgacgaggagctcgagcggtggctggaaaccagggacccccagcagttgcaagagaggcgcaagatgatgatggcggccgtgctggtcacggtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggtgtgtggcagcagtgcttggaagagagaaacctcaaagagctggacaaactcctctaccgccagcggcgggccctctggaccggcttcagcgagcgcacggtcgcctgcgccctggcagacatcattttcccagaacgcctgatgaaaaccttgcagaacggcctgccggatttcatcagtcagagcatcttgcaaaacttccgctccttcgtcctggagcgctccgggatcttgcccgccatgagctgcgcgctgccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaaaatcctggcccaattgcaatccatcaaccaagcgcgtcgagatttccttttgaaaaagggtcggggggtgtacctggacccccagaccggcgaggaactcaacccgtccacactttccgtcgaagcagcccccccgagacatgccacccaagggaaccgccaagcagctgatcgctcggcagagagcgaagaagcaagagctgctccagcagcaggtggaggacgaggaagagctgtgggacagccaggcagaggaggtgtcagaggacgaggaggagatggaaagctgggacagcctagacgaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcatcgtcagcatgagcaaggagattcccaccccctacatgtggagctatcagccgcagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggctgaagtcctcatgactaactctggggtacaattagcgggcgggtccaggtacgccaggtacagaggtcggaccgctccttactctcccgggagtataaagagggtgatcattcgaggccgaggtatccagctcaacgacgaggcagtgagctcctcaaccggcctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaactcggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatccagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgttgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggcgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcagagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccaccaccaaagttcgcccacacccacaaaacccgcgaaaatccagcgccgtcagcacttccgcaatttcagtctcacaacgtcacttccgcgcgccttttccctttcccacacacgcccttcgcccgccccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 246 - DNA, 6072 bp, Artificial Sequence
  Synthetic oligonucleotide RhAdApt61.Empty
taacattgaaaacgacagatacccctcgcagatcgcctccttcgtgttagcctggacccgagcctttgtctcggagtggtcccagttcctgtacgcggaagacctcggaacacctttggaagatcgccccctcaagtcggtctacggggacaccgacagcctttttgtcacggaagcgggacacagactcatggagacgcaaggtaagaaacgcatcaaaaaaaatggaggcaacttggtttttgatcccgctaaacccgagctcacgtggctggtggagtgcgagaccgtctgcgctcagtgcggagccgacgcctactcgcccgagtcggtcttcctggcccccaaactctacgccctcaagtgtctgcactgcaccaaatgtcagcacgtttccaagggaaagctgcgcgccaagggacacgcgaccgagtccctcagctacgacctcatgcttcgttgctatctggccgactcacagggagacgacgcccgcttcagcaccagcaggatgagcctgaagcgcaccctcgcaagcgcccagcccggggctcatcccttcaccgtcaccgagaccaccctcacccgaacgctgagaccctggaaggacagaaccctcgcggccctggacgcccaccggctggtgccctacagcgaaagtcggcccaacccccgcaaccaagaagtctgctggatcgagattccatagagcacgtcaccgagctctgggaccgactgtacttgcttcgtcagtcgcttgaaaagatgcccatggccgacggcctgaaaccgctgaaacacttcaacagcctggaagaactcttatccctgggtggggagaggctcttgcaaaacttagtgagtgaaaataaacatgtcagaagcatgatgaacgatgtagcccccctcctgcgccccgacggcagctgttcctctctgaactaccagctgcaacccgtcatcggggtcatctacggtcccacaggttgcggcaaatcccagctgttgcgtaacttgctttccacccagctcatcaatcccccgccagaaaccgtgttctttatcgccccccaggttgacatgatccccccctcggaaattaaagcctgggagatgcaaatttgtgagggcaactacgccccaggtccagatggaactatcattccccagtcgggcaccctcctaccccgctttgttaagatggcctatgatgagctcactctagagcaaaactatgatgtttccaacccccaaaacgtgtttgccaaagcggccgccaggggtcccattgccatcattatggatgagtgcatggaaaacctagggggtcacaagggggtctctaaattcttccacgccttcccctccaaactgcatgacaagttccccaagtgcaccggctacaccgtgctggtggtccttcataacatgaacccccgcagggacctaggtggtaacatagctaacctcaaaattcaagccaaaatgcatatcatctccccccgcatgcatccctcccagcttaaccgctttgttaacacctacactaaggggctgcccttggccatcagcctgctcctaaaggacatcttccagttccacgctcagaaaccctgctacgactgggtgatttacaacaccaccccggaacatgacgctctgcaatggtcctatctccacccccgggatggcctcatgcccatgtacttgaacatccaagcccatctgtaccgggtcttggaaaacatacacaaggtccttaacgaccgggacaggtggacccgagcctaccgagccaaaaaaaacaaataaagccgtttattttcaacaaatttgtttgtctttatttaagattctgtagaatcggggttagatggggatatctgcgcagctagttgatccaagcgccgagacagatcctccagccgaagcagcaccacattcagggcatcttcttgaaccagagaccgagatgccacagctgcagtggccaattggttatacagtccaaaatcagccgccatgccgcgagcagtagaagcggcagcagaagcggcagctgccgcggcagtgtccaacgatgatcccacggtggcataggtgagggtggcggaattcgcaggggcgaccggtcgtccgtccacggtggagcccactacattctgacgaactcctgcccaggaaggaagacgagatgtcagaaatggactgaacactcccccctcaaacgcgttgccgtccgtcgtcccgctcattttgaaacaccgcgcccacccctcatgcccctttataccctttgtagctccgcccctcacctcactcctcatcgctggattcatagtcggtacgcaggcaagacagcatgtggtggtccgtcctcagctcctcggtaacgttcagggttacaggatacaacctcaaatgattagctccgcattcacatgagcgacaacgagacttggtttcatcatatcttatcactttaaaaagttccattgacatgtcggatctagacatgataagatacattgatgagtttggacaaaccacaactagaatgcagtgaaaaaaatgctttatttgtgaaatttgtgatgctattgctttatttgtaaccattataagctgcaataaacaagttcggatctcgtctagaggatccgttaacgctagcgaattcaccggtaccaagcttccaatgcaccgttcccggccgcggaggctggatcggtcccggtgtcttctatggaggtcaaaacagcgtggatggcgtctccaggcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacatggcggtaatgttggacatgagccaatataaatgtacatattatgatatggatacaacgtatgcaatggccaatagccaatattgatttatgctatataaccaatgaataatatggctaatggccaatattgaccacctaggctctactcgccggcactcaagagtggcctcttgatgatctgacagcgtttaaatacccagcgaaaacgctgaggagtacaataaatgggacctttgagccttctcgtggtactgccacgtagcgaaacctccccgtcagcgcccaaagttcactgctgatcagcagaaattccgcccagtcataaaaagtacatattaacctcaacttcctcattacccagttttcgcgccaatttacacaaaacttacaagtatacgcccaaattacccaacttccggcataaaacctccttccgcatacgtaaaagctaagcgcctccccacgcccgcctgcgaacctcgccccgccccgcccctctccccattcccacgtcaccccggccccgcctcgctcctccccgctcattatcatattggcacgtttccagaataaggtatattattgatgatgttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaat

SEQ ID NO: 247 - DNA, 38304 bp, Artificial Sequence
  Synthetic oligonucleotide pWe.RhAd61.pIX-rITR.dE3
gacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggtcgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggtggatttgatatttacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgtctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccataacggaccagttgacgacttgcatgccgggttgggtaatctccgtgtacttgaggcgcgagtaggcgcgggactcgaacacgtagtcgttgcatgtgcgtaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggctgcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgcctcaccacggacgtgaaggaggcgctggctcagaaggagcgctttctgagggacagcaatctgggttctctggtggcactcaacgccttcctgagcacgcagccggccaacgtgccccgcgggcaggaggactacgtgagcttcattagcgctctgaggctgctggtgtccgaggtgccccagagcgaggtgtatcagtccggaccggattacttttttcagacgtcccgccagggcttgcaaacggtgaacctgactcaggcctttaaaaacttgcaaggtatgtggggcgtcaaggccccggtgggcgatcgcgccaccatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagtcgggctctgggtcaggaagacaccggcagcttggaagccacgttgaactttttgctgaccaaccggaggcaaaaaataccctcccagttcacgttaagcgccgaggaagagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaacccaacagccccgatacgagtggtttgagtttactattccagagggcaactactccgagaccatgactatcgatctaatgaataacgcgatcgtggacaattacctgcaagtggggaggcagaacggggtattggaaagcgatatcggtgtgaaatttgataccagaaacttccgactggggtgggatcccgtgaccaagctggtgatgccaggcgtgtacaccaacgaggcttttcaccccgacatcgtgctgcttccggggtgtggtgtggactttactcagagccgcttgagtaacctgttaggaatcaggaagcgccgtcccttccaggagggctttcaaatcatgtatgaggacctggagggaggtaacattccaggcttgctagacgtgccggcgtatgaacaaagcttacagcaagcccaagaggaggggcgagtaactcgcggagacacctttgctacggctccccatgagttggtgattcagcctttaacgaaagacagtaaaaacagaagttacaaccttatacccaactctacggatacactgtaccggagctggttcctggcttacaactacggcgatcccgagaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtccaccgcgcttacccacgtgttcaatcgctttcccgagaaccagattttggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctcgggccgaacggcggtagacgataccatagatgccgtgattgccgacgcccgccggtacaatcccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgcctccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcggcgcagggttcaatggaaagggcgacgggtacaacgcgttttgaggccgggcaccgcggtagtttttaccccgggagagcggtcggccgttaggggttttaaaaggcagtacgacgaggtgtacggcgacgaggacatattggaacaggcggctcgacagatcggagaatttgcctacggaaagcgttcgcgtcgcgaagaactggccatcgccttagacagcggcaaccccacacccagcctcaaacccgtgacgctgcagcaggtgcttcccgtgagcgccagcacggacagcaagaggggaataaaaagagaaatggaagatctgcagcctaccatccagctcatggttcctaaacggcagaggctggaagaggtcctggagaagatgaaagtggacccaagcatagagccggacgttaaagtcaggccgatcaaagaagtggcccctggactcggggtgcagacggtggatatccagatccccgtcacgtcagcttcgaccgccgtggaagccatggaaacgcaaaccgaaacccccgccgcggttggtaccaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcggcgcgtggcccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaaatggaggtcgaggaagtagaagtagaggaaaagctgcccccgctggagaaagttcccggtgcgcctccgaggccgcagaagcggcccaggccagaactagaagaaactctggtgacggagagcaaggagcctccctcgtacgagcaagccttgaaagagggcgcctctccaccctcctacccgatgactaagccgatcgcacccatggctcgaccggtgtacggcaaggattacaagcccgtcacgctagagctccccccgccgccaccgccgccccccacgcgcccgaccgttccccccctgccggctccgtcggcgggtcccgtgtctgcaccatccgctgtgcctctgccagccgcccgtcccgtggccgtggccactgccaggaaccccagaggccagagaggagccaactggcaaaacacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagcgccgcttccaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctacttcgacatccggggggtgctggataggggtcctagcttcaagccctactccggcaccgcttacaactccctggcccccaagggcgcccctaaccctgcagaatgggaagatactaatgacagcaacaaactcaaagtgaggggacaggcgccttatgttagcacgttcggcgccgctacggcgcttacaaaagatggcattcaggtgggagtgaccgtatcagagtccgcacgaactccgcagtacgcggacaaaagttaccaaccagaacctcaaattggggagacagagtggaacagcgaagtaggtaacgatgacaaattagcaggcagggtgctaaaaaaatcaacgccaatgttcccttgttacggatcatatgccaaacccaccaacgaaaaaggcggacaagcaatacagcctgccggcagcagcggagacactaatccggcagtagagttgcagttcttcgccactactagcgctactactactccaaaagcagtgttatatgcagaggacgtagccatagaagcaccagatactcatttggtgtttaagccgacagtaactgcaggaactacaagttcggaagctctgttaacccaacaagctgcacctaaccgtccaaactacattgcattcagagataacttcattggacttatgtactacaacagtacaggaaatatgggagtgctggccgggcaggcatctcagctaaatgcagtggttgatttgcaagacagaaacactgaactgtcttaccagctaatgttggatgctctcggagaccgcagtcggtacttctctatgtggaatcaagcagtggacagttacgatccagatgttagaattgtggaaaatcacggagtggaggatgagttaccaaattattgctttcctttgggagggatggtagtaactgacacctacacgcccataaaacccaatggcagtggaagtgtcacgtggacagccaatactgacgttttcagcaatagagtggaaataggctccgggaacctgttcgccatggaaatcaacctgcaagccaatctgtggcggagctttctgtattccaacatcgggctgtatctccccgactccctaaaaatcacccccgacaatattacgctgccagagaacaaaaacacttaccagtacatgaacggtcgcgtgacacctcccgggctcatagacacctacgtcaacgtgggtgcgcgctggtcccccgatgttatggacagcatcaacccctttaaccaccaccgcaacgcggggctgcgttaccgctctatgctgctgggcaacggccgctacgtgcccttccacattcaggtgccccagaaattctttgccattaagaacctgctgctgctccccggttcctacacctacgagtggaacttccgcaaggacgtgaacatgatcttgcagagctcgctgggcaatgacctgcgagtggacggagccagcatccgcttcgacagcatcaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcctccgtcagctggcccggcaacgaccgtctgcttacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcgacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctcacgcagaagaagttcctctgcgaccgggtaatgtggaggatacccttctctagcaacttcatgtctatgggatccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggagaccgggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttattttaacatgacacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccaaaactgccgcaccagctgcagggctcccatgacgtcgggcgccgatatcttgaagtcgcagttagggccggagctcccgcggctgttccggaacacggggttggcacactggaacaccatcacgctggggttgtggatactggccagggccgtcgggtcggtcacctccgacgcatccagatcctcggcgttgctcagggcaaacggggtcagcttgcacatctgccgcccgatctggggtactaggtcgcgcttgttgaggcagtcgcagcgcagagggatcaggatgcgtcgctgcccgcgttgcatgatagggtaactcgccgccaggaactcctccatttgacggaaggccatctgggctttggcaccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgtccgttctcgctggttacatccatttctaacacatgctccttgcagaccatctccactccgtggaagcagaacaggacgccctcctgctgggtactgcgatgctcccatacggcgcatccggtgggctcccagctcttgtgttttacccccgcgtaggcttccatgtaagccatgaggaatctgcccatcagctcggtgaaggtcttctgattggtgaaggtcagcggcaggccgcggtgctcctcgttcaaccaagtttgacagatcttgcggtacacggttccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcggggctcatctcccgcaagtagggggtgatggagcttcccgcttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgatcgtgttcagctactttgagctgccggacgagcaccctcagggtccggctcacgggttgaaactcgagatcgagaacgcgctcgagtctcgcctcatcgacaccttcaccgcccgacctctcctggtagaaatccaacgggggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctccctatagaggtatcatacaaactgtttactttgacaactctactactctcctaaccctcaactgctcttgctccctctgtcactgtcacgcacctgattgcatttctaaactaattaaaactctctgtgctttaggtgatatatttaagatgtaaattagtaacaataaacgtaccttaaatttgacaacagttttctggtgacatcattcagcagcaccactttaccctcttcccagctctcgtatgggatgcgatggtgggcagcaaatttcctccaaaccctaaaagaaatattactgtctacttccttattatttcccacaatcttcatcttttcagagatgaaaagaacccgagttgatgaagacttcaatcccgtctatccatataacacagagccgactccctccgctccctttgttactccgccctttgtttcgtccaatggactcatggaatccccatcaggggtattatccattcgttacacccaacccattactgtagttaacaattccctaagtctaaaaacaggaaatggtttgtctgtgagtagtgatgggaaactgcaaattgccataaacactaacaaaggactaagtaatgaggataacaagattgctgttaaggttggtcctgaactatatttcgacgctgacggtgctatcaccatgaattctcaaactctttggaccaatccgaacgaaactgcaaactgtagcgtctttcaaagcttagactccttattaactttatgtttaactaaaaacggagcccacgtattaggaagcgtaagcttaaccggcctttctggccccctattaaaaatgaccacaacctcagttaccgttcaactaatctttgacagcaacggagtccttactacttcccaacttaatactaactcttggggcatgcgcgcgaacacaaatctaaatgctccagttacaaacgccttaccatttatgcccaacagtactatttatgcaagaggaaacgcaggagaacccagaagcaactactacgtacaaacatacttacgaggcaacctaaataaacaaatcactcttagtatttcattcaacgcttcttcctcaggctactccttaacatttaaatggagtgccattgccacagaaaagtttgccacccctacatcgtcgttctgttacatcgcagaacaataaataccgcactgtttcccttcgtttgcagatgaagcgaacccgaattgaagacgatttcaaccctgtttacccctacgactcagtttctgctccagcagttccatttgtatcccctccatttgtaaacagtgatggtttaaaagaaagtcctcctggagtattaagtttgcaaattgccaaacctctgctctttgatgcgcaaagaaaagtcactctctctttgggtcgaggactagccgttaattcagccggacaactagaaagtacgcaaatcctccaaactaaccctccattgttactatccaacaacatgctttccttagactgtgcttttcccctatctgtagcgaacaaccaactatcccttaaatacacagatccactccgtttagttaatgacagtctcacattcaattttacatctccgcttcatttggctaacggtaaccttacctttagttacacaactcctcttaatattattaacaacagtttagccttaaactattcaccccctctacgacttgtaaacagcaatcttactatggggtacgccgatccatttcaagtggcaaactcaaacctatctctaaaaatcgctaacccttcaggactccgcattcgaaacggtaacttgcaaattgccgctggttatggcttacaaattgcaggtaataacgacctatatgtaagacgagaaacacctctagacgtttacacatctggagcaaaagaaggaatattatacctccggttaggccctaactctggattgcaagttcttagtgacaaccttagtctcaaaaccggtcaaggactgcaaattttgagcaacaccctgtctgttaaactaggacgtggtttacgctttgacagcagcggagccattgaacttagcacatgatgtaataagtttatccaaaaaataaaacatttatttttcagatgaaacgagctcgaattgaggaagacttcaatcctgtgtacccttacgatcccccatatgctcccatcatgccattcattacacctccatttacctcgtctgatggcttgcaagaaaaaccttttggtgttttaagtttaaactacaaaaatccgattactactcaaaatggttctttaactctcaaactaggaaatggcctcaacattaataatcaaggagaactcacctcaacagcaggcgcagtgcaaccccctctcactaatgccgacaacaaattaaccctagcatacagcgagcctttaacagtacaaaacaaacgcctaacgctctcccacagcgcccctctagcggttgctgacaattctttaagtttacaagtcacagaccctattttcataaatgctgacaacaaactagctttacaaacagacgccccacttaacacaactaccggagtccttcgcctgaaaagcgccgcacccttagggcttgtagaacaaaccctaaacctgttgtttgccaaacccttatatttacagggtgacttcctagcattagccattgaacgcccgctagcagtgactgcggacggttcgctagccctggcacttgatccgcccctgaaaaccagtaacacggggttaggactcttaactgccgctccgctcacggttacaaatggaaacctgaacttaaatgttaaacgcccctttgttatacaagacaatagtctttacatggactttagagctccactgcgactgtttaacagcgagccgcaactaggagttaacttcacttcccctcttacggtacgggcagatgccttaacattagacactggaaacggattgcaggtgctttttaacaaactcacattaaatctcggaagagatttggaatatgacaatggagctatagccgttaggttaaacccagctgcccctcttcagtataccaaccagcttcaacttaacctgggagctggcctgcgcttaggtgtttctaagaaattaacagtagatgtggatgaaaataaaggattaacatggaatggtaatcaacttgtggcaagcctaggtactggattagcttttgacaactatggaagaataagtgttgtttcgacagccgctggcgatgatactctgtggacaacggctgacccatcacccaactgtacggtgtatgaacaactagatgctaggctgtggctaagtcttgttaaatgtggcggtatggttcagggaagtgttgctttaaaagccgaaaaaggccgcttgcttaatcccactgcttcttttatttctattgttatgtacttcaatagatatggcgtttggcgcaccgactatcccacaattggtgatgaccaaggcattatagctaacagtgccacatggggatacagacgtggagaatccgccgacacaaacgtcactaacgctttaaaatttatgcctagctcacgaaggtatcctattaaccagggaaataacattcagaaccaaatgattacatacacctgcatacagggagatgttagcatgcctgtgcctttaaaaatcacctttaatcatgcttttgagggttactccttcaaatttacttggcgtgtggtcgccaatcaaaggtttgatattccctgttgttcattttcttacatcacagaagaataaagacaactttcttttttaatttcttttttattttacacgaacagtaagacttcctccccccttccatttgacagcatacaccagcctctcccccttcatggcagtaaactgttgtgagtcagtccggtatttgggagttaaaatccaaacagtctctttggtgatgagacatcgatccgtgatggacacaaatccctggggcaggttctccaacgtttcggtaaaaaactgcgtgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagccttacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgaccgtccaaccttactttaacataaatcaggtgtctgccgcgtacaaacatactacccgcatacagaacttcccggggcaaacccctgttcaccacctgcctgtaccagggaaacctcacatttatcagggagccatagatagccattttaaaccaattagctaataccgccccaccagctctacactgaagagaaccgggagagttacaatgacagtgaataatccatctctcataacccctgatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcaatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaagaatcattaaactaaagaagcttggcgaacggtgggatatatgacacgctccagcagcagacaggcaaccggctgtccccgggaaccgcggtaaaattcatccgaatgattaaaaagaacaacagacacttcccaccatgtactcggttggatctcctgagcacagagcaatacccccctcacattcatatccgccacagaaaaaaagcgtcccagatacccagcgggaatatccaacgacagctgcaaagacagcaaaacaatccctctgggagcaagcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctgaaatccacccaacagcctatagctatatatacactccgcccaatgacgctaataccgcaccacccaccaccaaagttcacccacacccacaaaacccgcgaaaatccagcgccgtcagcacttccgcaatttcagtctcacaacgtcacttccgcgtgccttttcccattcccacacacgcccttcgcccgccccgccctcgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 248 - DNA, 6082 bp, Artificial Sequence
  Synthetic oligonucleotide RhAdApt62.Empty
catcatcaataatataccttattctggaaacgtgccaatatgataatgagcggggaggagcgaggcggggccggggtgacgtgcggtgacgcggggtgacgcggggtggcgcgagggcggggcgggtgtgcggaggcgcttagtttttacgtatgcggaaggaggttttataccggaagttgggtaatttgggcgtatacttgtaagttttgtgtagtttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 249 - DNA, 37663 bp, Artificial Sequence
  Synthetic oligonucleotide pWe.RhAd62.pIX-rITR.dE3
gacatgtcaatggaactgtttaaagtgataagatatgatgaatccaagtctcgttgtcgcccatgtgaatgcggagctaatcatttgaggttgtatcctgtaactctgaacgtcaccgaggagctgagaacggaccaccacatgctgtcttgcctgcgcactgactatgaatccagcgacgaggagtgaggtgaggggcggagccaaacgggtataaaggggcgtgaggggtcggtgcggtgtttcaaaatgagcgggacgacggacggcaatgcgtttgaggggggagtgttcagcccatatctgacatctcgtcttccttcctgggcaggagtgcgtcagaatgtagtgggatccaccgtggacggacgaccggtggctcctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtccctggttcaagaagatgccctgaatgtgattctgactcgcctggagatcatgtcacgccgcctggacgaactggctgcgcagatatcctcaactaaccccgataccacttcagaaccttaaataaagacaaacaaatttgttgaaaagtaaaatggctttatttgttttttttggctcggtaggctcgggtccacctgtcccggtcgttaaggaccttgtgtatgttttccaagacccggtacagatgggcttggatgttcaagtacatgggcatgaggccatctcgggggtggagataggaccattgcagagcgtcatgctccggggtggtgttgtaaataacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcatcttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtggcctcctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactgggggatgatagttccatctgggcctggggcgtagttgccctcacaaatctgcatttcccaggccttaatttccgaggggggtatcatgtccacctggggggcgataaagaacacggtttctggcgggggattgatgagctgggtggaaagcaagttacgcaacagttgggatttgccgcaaccggtgggaccgtagatgaccccgatgacgggttgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtctgccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgagatcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatttcggcgctcaagttgtcagtttctacaaacgaggaggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggtggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggatttaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatttcgtcgaagccgttaatgttgtggcccacgatgtaaagttccataaagcgcggctgtcccttgagggccggcgcttttttcaactcctcgtaggtgagacagtccggcgaggagagacccagctcagcccgggcccagtcggagagttgaggattagccgcgaggaaggaactccatagatccaaggccaggagagtttgcaagcggtcgcggaactcgcggaactttttgcccacggccattttctccggtgtcactacgtaaaaagtgtcggaccggtcgttccagacgtcccatcggagctctagggccagctcgcaggcttggtgaacgagggtttcctcgcccgagacgtgcatgaccagcataaagggtaccagttgtttcccgaacgagcccatccatgtgtaggtttctacgtcgtaggtgacaaagagccgctgggcgcgcgcgtgggagccgatcggaaagaagctgatctcctgccaccagctggaggaatgggtgttgatgtggtggaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatcccattcgccttggcggtgggagtttgcgtctgcgtccttcttctctgggtggacgacggtggggacgacgacgccccgtgtgccgcaagtccagatctccgccacggaggggcgcaggcgctgcaggaggggacgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgtcgtctctgcgtgaataccaccggcccccgggtcctgaacctgaaagagagttccacagaatcaatgtctgcatcgttaacggcggcctgcctgaggatctcctgtacgtcgcccgagttgtcctgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgttgccgaaggagtcgcgcgctcgcatgaccacctgggccacgttaagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggctcgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctctcggccagcacggcctgttggatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggcgcgggactcgaacacgtagtcgttgcatgtgcgcaccagatactggtagccgaccagaaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggtggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggaacccgagggtcgctggctcttggatctgattaatatcctgcagagcatcgtggtgcaggagaggggtctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacacacgagaaagtcctgactatcgtgaacgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaacttgcaaggcatgtggggcgtcaaggccccggtgggcgatcgagccaccatctccagtctgctgacccccaacactcgcctgctgctgctcttgatcgcgccgttcaccaacagtagcactatcagccgtgactcgtacctgggtcatctcatcactctgtaccgcgaggccatcggtcaggctcagatcgacgagcatacatatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgcgtccgatagcattttcacgccggctaatcgccgattccagaagaaggagggcggagacgagctccccctctccagcgtggaggccgcctctaggggagagagcccctttcccagtctgtcttccgccagtagcggtcgggtcacgcgcccgcggttgccgggggagagcgactacctgaacgaccccttgctgcgaccggctaggaagaaaaatttccccaacaacggggtggaaagcttggtggataaaatgaatcgttggaagacctacgcccaggagcagagggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaagggcgttcgagtcgcctgtactaataaaaaagaagcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagaacggggtattggaaagcgatatcggtgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttagggattagaaagcgccgccccttccaagagggctttcagatcatgtatgaggacctggagggaggtaatatacccgccctactggacgtgtcaaagtatgaggacagcgtgaagaaggcggaagctcagggacgagaaattcggggcgacacatttgcggtggcaccccaagacctggtgatagagcctttgactaaagacagcaaaaacagaagctacaacattattaccggtactatggacaccaaatatcggagctggtttctggcttacaactacggggatcccgaaaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtctaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgtgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgccagcatggccagacccaggagagggaacgtgtactgggtgcgcgattctgtgacgggagtccgcgtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgccttagacagcggcaaccccacgcccagcctcaaacccgtgacgctgcagcaggtgcttcccgtgagcgccagcacggacagcaagaggggaattaagagagaaatggaagatctgcatcccaccatccaactcatggtccctaaacggcagaggctggaagaggtcctggagaagatgaaagtggaccccagcatagagccggatgtaaaagtcagacctattaaggaagtggcccccggtcttggggtgcaaacggtggacattcaaatccccgtcaccaccgcttcaaccgccgtggaagccatggaaacgcaaacggaaacccctgccgcgatcggtaccagggaagtggcgttgcaaacggagccttggtacgaatacgccgcccctcggcgtcagaggcgacccgctcgttacggccccgccaacgccatcatgccagaatatgcgctgcatccgtctatcctgcccacccccggctaccggggagtgacgtatcgcccgtctggaacccgccgccgaacccgtcgccgccgccgctcccgtcgcgctctggcccccgtgtcggtgcgccgcgtaacacgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggacaccaactttcaagaaaaagtggtcaacggggtggtgaccggcatccacggcgcggtagatctcgccaatcaagcggtgcagaaagagattgataggcgtttggaaaattcgcgggtaccgccgcagaggggggatgaggtggaggtcgaggaagtagaagtagaggaaaagctgcccccgctggagaaagttcccggtgcgcctccaagaccgcagaagcggcccaggccagaactagaagaaactctggtgacggagagcaaggagcctccctcgtacgagcaagctttaaaagagggcgcctctccaccctcctacccgatgactaagccgatcgcacccatggctcgaccggtgtacgggaaggattacaagcccgtcacgctagagctccccccgccgccaccgccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagcttcaagccctattccggcaccgcttacaactccctggcccccaagggtgctccaaacccatcagagtggaacggaactgacagcaaaaccaatgtcagaggtcaagcaccattcattagtgatgcaataactaaagagggcataaaagttggtacagacacaggaaaccccggacaagcaatttatgctaaaaaagagtatcagcctgaaccccaagtgggggaaacgcaatggaatagcgacgttggagcaacagacaaagcggcaggacgaattttaaagaaaacgacacccatggttccgtgctatgggtcttatgccaaacccacaaacgaagaagggggtcaggctacaaaccagcaggtagatatgcagttttttgctaccggcagttctaatactacaccaaaggttgtgctgtactctgaagacgtgacgattgagacgcccgacacccacttagtatttaagccaattgtaacagcaggaaccacaaatgcagaagctttgttagcgcagcaagctgctcccaatcgaccaaactacattggctttagagataattttattggtcttatgtactacaacagcactggaaacatgggagtgctggctgggcaggcttcgcagttaaacgctgtggttgatttgcaagacagaaacactgagctatcttatcaactaatgctggatgctttgggggatagaagcagatacttttcaatgtggaatcaagcggtggacagttacgatcccgatgtgagaattgtagaaaaccacggagtagaggacgagttaccaaattactgtttcccgttaggcggtatggcagtaactgatacctacacaggtattaaacctgataatggaggcactacattctcaaatgatgacacttttgcaactagaggaatagaaataggttctggaaacatgttcgccatggagattaatctgcaggctaatctgtggcgtagtttcttgtattccaacatcgggctgtaccttccagacaccttgaaaatcactcccgacaacataacgttgccggacaacaaaaacacctaccagtacatgaatggtcgtgtcactccccccgggcttgtggacacctacgtgaacgtgggtgcgcgctggtcccccgacgtcatggacggcattaaccccttcaaccaccaccgcaacgcgggcttgcgctaccgctccatgctcttgggcaacggccgttatgtgccttttcacattcaggtgccccaaaaattctttgccattaaaaacctgctgcttctccccggttcctatacctatgagtggaacttccgcaaggatgtcaacatgatcctgcagagctcgctgggtaatgacctgcgagtggacggggccagcatacgctttgacagcattaacctgtatgccaacttttttcccatggcccacaacacggcctctaccctggaagccatgctgcgcaacgacaccaatgaccagtccttcaacgactacctgtgcgcagctaacatgctgtaccccatccccgccaatgccaccagcgtgcccatctctattccttctcggaactgggctgccttcaggggctggagttttactcgcctcaaaaccaaggagactccctcgctgggctccggttttgacccctacttcgtctactccggctccatcccctacctagatggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggttcctaattcaaatgctcagtcactataatataggttaccagggcttctatgtgcccgagaactacaaggaccgcatgtactccttcttccgcaacttccaaccaatgagccggcaggtggtagataccgtgacttatacagactacaaggatgtcaagctcccctaccaacacaacaactcagggttcgtgggctacatgggacccaccatgcgagaggggcaggcctaccccgccaactacccctatcccctgattggggccaccgccgtgcccagcctcacgcagaagaagttcctctgcgaccgggtgatgtggaggatccccttctctagcaactttatgtcgatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcctaacagcatgcttcacagcccccaggtcgcccccaccctgcgccgtaaccaggaacacctgtatcgctttttggggaaacactctgcctactttcgccgccaccggcagcgcattgaacaggccacagcctttgaaagcatgaaccaaagagtgtaatcaataaaaaaaccattttattttaacatgacacgcgcttctggcgttttttattaaaaatcgaagggttcgagggaggtgtcttcgtgcccgctggggagggacacgttgcggtactggaaacgggcgctccaacgaaactcggggatcaccagccgcggcagaggcacgtcttccaggttctgcttccaaaactgccgcaccagctgcagggctcccatcacgtcgggcgccgatatcttgaagtcgcagttagggccggagctcccgcggctgttgcggaacacggggttggcacactggaacaccatcacgctggggttgtggatactagccagggccgtcgggtcggtcacctccgacgcatccagatcctcggcgttgctcagggcgaacggggtcagcttgcacatctgccgcccgatctggggcaccaggtcgggtttgttgaggcaatcgcagcgcagagggatgaggatgcgacgctgcccgcgctgcatgatagggtaactcgctgccagaaactcctccatctgacggaaggccatctgggccttcgtgccctcggtgtagaatagcccgcaggacttgctagagaatacgttattgccgcagttgatgtcttccgagcagcagcgggcgtcttcattcttcagctgaaccacgttgcgaccccaacggttctggaccaccttggctctagtggggtgctccttcagcgcccgctgcccgttctcgctggtcacatccatttccaccacgtgttccttgcagaccatctccactccgtggaagcaaaacaggacgccctcccgctgggtattgcggtgctcccacacggcgcacccggtgggctcccagctcttgcgtttcacccccgcgtatgcttccatgtaagccatgaggaatctgcccatcagctcggtgaaggtcttctggttggtgaaggttagcggcaggccgcggtgctcctcgtttaaccaagtttgacagatcttgcggtacacgactccctggtcgggcagaaacttaaaagccgctctgctgtcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttgaaactccacggtgccgtccgcgcggcgtactctgcgcaccggagggtagctgaagcccacctccaccacggtgccttcgccctcgctgtcggaaacgatctccggggatggcggcggcggcgcgggtgttgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgtcgagatttccttttgaaaaagggtcggggggtgtacctagacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgtcagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcacctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggagccgatcgtcttcagctactttgagctgccggacgagcaccctcagggaccggctcacgggttgaaactcgagatcgagaacgcgctcgagtctcgcctcatcgacgccttcgccgcccggcctctcctggtagaaaccgaacgcgggaccactaccatcaccctgttctgcatctgccccacgcccggattacatgaagatctgtgttgtcatctttgcgctcagtttaataaaaactgaactttttgccgcaccttcaacgccatctgtgatttctacaacaaaaagttcttctggcaaaggtacacaaactgtattttattctaattctacctcatctatcgtgctgaactgcgcctgcactaacgaacttatccggacctgttgagggagctatcctgtgtcactgtcatgcgcctgattgtatgcccaaactaattagaactctctgcgccttatgtgatatatttaagatgtgaatcgggatcaataaacttaccttaaatttgacagcagttttctggtaacatcattcagcagcaccactttaccctcttcccaactctcgtatgggacgtgatggtgggcggcaaacttcctccaaaccctaaaacaaacattaatatccacttccttgtccttacccacaattttcatcttttcatagatgaaaagaaccagagttgatgaagacttcaaccccgtctacccttatgactccacatccactcctgcggtcccctttatatcccccccgtttgtaaacagcgatggtcttcaggaaaaccctcctggagtcttaagtttacgaatagctaaacccttgtattttgacatggaaaggaaactagcgctttcacttggaagaggattggcaattacctccaccggacagctagaaagcacacagagcgtgcaaaccacccctccattagttgtcaataacagcaacacgcttgtcctgcgttattcctccccgttaggcttatcgggtgacaatttaatactaaattgctccgatcctctccgcgtaataaacaacagcctcacattcagctacctatctccacttcgttttgaaggtggcagtcttacattcaattacacatctccccttaaactgttgaacagcagccttgcgatcggaataaattccaacaaaggtctcggcaatgacagcgatgaactttctgtcaaactaacatcagatctgaagtttaacaacgatggaaaaatagcttttggtatacaaagcctgtgtaccacccccacagccgcctctaactgtaccgtttttaccaacggtgattctttactctgtttatgtttaaccaaatgtggagctcacgtgttaggaagtgtgagtttaaccggaatgcaaggaaccataacagccatgacacagaactacattagtattcaatttctatttgaccacaatggtgcgttgacttcatcaccgctcctcaacaacaacacttggggtatacggcaaagcgacacttcgtccgctaaccccgcctacaatgctcttgcatttatgcctaacagcactgtatatgtaagaggtcaaagtggtgagcccagaaataactattacacccaaacataccttaggggaaacgttaaaaagccaattatccttaccgttacctacaactcggctgcttcaggttattcactaacttctaaatgggatgctgtggtaacagaaaaatttgccactccaacatcttctttttgctatattacagaacaataaattcctattaccccaccaattcgtttttttcagatgaaacgggccagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacggctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggtgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaataaagaacaactttttttaaatttcatttttattttacacgcacggtaaggcttcctccacccttccatttgacagcatataccagcctctcccccttcatggcagtaaactgttgtaagtcagtccggtatttgggagttaagatccaaacagtctctttggtgatgaaacgtggatccgtgatggacacaaatccctgggacaggttctccaacgtttcggtaaaaaactgcgtgccgccctacaaaacaaacaggttcaggctctccacgggttatctccccgatcaaactcagacagggtaaaggtgcggtgatgttccactaaaccgcgcaggtggcgctgtctaaacctctcggtgcgactcctgtgaggctggtaggaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcaaacccctgttcaccacctgcctgtaccagggaaacctcacatttatcagggagccatagatagccattttaaaccaattagctaacaccgccccaccagctctacactgaagagaaccgggagagttacaatgacagtgaataatccatctctcataacccctgatggtctgatggaaatccagatctaacgtagcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaatgcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagagatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgcgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaaacgtcccagatacccagcgggaatatccaacgacagctgcaaagacagcaaaacaatccctctgggagcaatcacaaaatcctccggtgaaaaaagcacatacatattagaataaccctgttgctggggcaaaaaggcccggcgtcccagcaaatgcacataaacatgttcatcagccattgccccgtcttaccgcgtaaacagccacgaaaaaatcgagctaaaatccacccaacagcctatagctatatatacactccgcccaatgacgctaaaaccgcaccacccacgaccaaagttcacccacacccacaaaacccgcgaaaatccagcgccgtcagcacttccgcaatttcagtctcacaacgtcacttccgcgcgccttttcacattcccacacacacccgcgcccttcgacccgcccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 250 - DNA, 6080 bp, Artificial Sequence
  Synthetic oligonucleotide RhAdApt63.Empty
catcatcaataatataccttattctggaaacgtgccaatatgataatgagcggggaggagcgaggcggggccggggtgacgtgcggtgacgcggggtgacgcggggtggcgcgagggcggggcgggtgtggggaggcgcttagttttcacgtatgcggaaggaggttttataccggaagttgggtaatttgggcgtatacttgtaagttttgtgtaatttggcgcgaaaaccgggtaatgaggaagttgaggttaatatgtacgttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagccacgaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 251 - DNA, 38335 bp, Artificial Sequence
  Synthetic oligonucleotide pWe.RhAd63.pIX-rITR.dE3
gccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagccacgaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacaaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttttcggcccggtagaggatctgcctgaagatggcgtgggagttggaagagatggtggggcgttggaagacgttaaagttggctccgggcagtcccacggagtcttggatgaactgggcgtaggattcccggagcttgcccaccagggctgcggttaccagcacgtcgagagcgcagtagtccaacgtctcgcggaccaggttgtaggccgtctcttgttttttctcccacagttcgcgattgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccattggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagcggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtgtcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacagtgggtcgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcatgccgggttgggtgatctccgtgtacttgaggcgcgagtaggcgcgggactcgaacacgtagtcgttgcatgtgcgcaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcggccctggtgaattcccggacgcggttccagatgttgcgcagggggcggaagcgttccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagaggggcctcagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcattatggcgctgactacccgcaaccccgaggcttttagacagcaaccccaggccaaccgtttttcggccatcttggaagcggtggtgccctcccgcaccaaccccacgcacgagaaagtcctgactatcgtgaatgccctggtagacagcaaggccatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggctctctggtggcactcaacgccttcctgagcacgcagccggccaacgtgccccgcgggcaggaggactacgtgagcttcatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgtgactcgtacctgggtcatctcatcactttgtaccgcgaggccatcggtcaggctcagattgacgagcatacatatcaggagatcactaacgtgagccgggccctgggtcaggaagataccggcagcctggaagccacgttgaactttttgctaaccaaccggaggcaaaaaataccctcccagtttacgttaagcgccgaggaggagaggattctgcgatacgtgcagcagtccgtgagtctgtacttgatgcgggagggcgccaccgcttccacggctttagacatgacggctcggaacatggaaccgtccttttactccgcccaccggccgttcattaaccgtctgatggactacttccatcgcgcggccgccatgaacggggagtattttaccaatgccatcctgaatccgcattggatgcccccgtccggcttctacaccggcgagtttgacctgcccgaagccgacgacggctttctttgggacgacgtgtccgacagcattttcacgccgggcaatcgccgattccagaagaaggagggcggagacgagctccccctctccagcgtggaggcggcctctaggggagagagtccctttcccagtctgtcttccgccagcagtggtcgggtaacgcgcccgcggttgccgggggagagcgactacctgaacgaccccttgctgcggccggctaggaagaaaaatttccccaacaacggggtggaaagcttggtggataaaatgaatcgttggaagacctacgcccaggagcagcgggagtgggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaactcggcagccccgatacgagtggttcgagtttaccattccagagggcaactattccgaaactatgactatcgatctcatgaataacgcgatcgtggacaattacctgcaagtggggagacagaacggggtgctggaaagcgatatcggcgtgaaattcgataccagaaacttccgactggggtgggatcccgtgaccaagctggtgatgccaggcgtgtacaccaacgaggcttttcaccccgacatcgtgctgctgccggggtgcggtgtggacttcactcagagccgtttgagtaacctgttaggaattagaaagcgccgcccattccaagagggctttcaaatcatgtatgaggacctggagggaggtaatatacccgccttactggacgtgtcgaagtacgaagctagcatacaacgcgccaaagcggagggtagagagattcggggagacacctttgcggtagctccccaggacctggaaatagtgcctttaactaaagacagcaaagacagaagctacaatattataaacaacacgacggacaccctgtatcggagctggtttctggcttacaactacggagaccccgagaaaggagtgagatcatggaccatactcaccaccacggacgtgacctgtggctcgcagcaagtgtactggtccctgccggatatgatgcaagacccggtcaccttccgcccctccacccaagtcagcaacttcccggtggtgggcaccgagctgctgcccgtccatgccaagagcttctacaacgagcaggccgtctactcgcaacttattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagcgcttggcgtggtggctcctaaagttctttctagtcgcaccttctaaaaacatgtccatcctcatctctcccgataacaacaccggctggggactgggctccggcaagatgtacggcggagccaaaaggcgctccagtcagcacccagttcgagttcggggccacttccgcgctccttggggagcttacaagcgaggactctcgggtcgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggcaggcagaagggctatgcgccgcgctgccgccaacgccgccgccgggagggcccgccgacaggctgcccgccaggctgctgctgccatcgctagcatggccagacccaggagagggaacgtgtactgggtgcgtgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggacagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgttacgtcagcttcaaccgccgtggaagccatggaaacgcaaaccgaaacccccgccgcggttggtacgaaagaagtggcgttgcaaaccgacccctggtacgaatttgccaccccccggcgtcagaggcgacccgctcgttacggccccgccaatgccatcatgccagaatatgcgctgcatccgtctatcctgcccacccccggctaccggggagtgacgtatcgcccgtcgggaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgcagccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgagggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgtggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggctcaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaatgcagttgtggacttgcaagacagaaacaccgaattgtcataccagcttatgctcgacgcattgggagacagaagtcgatacttttcaatgtggaatcaagctgttgacagttacgatccagatgttaggataattgaaaaccacggcgttgaagacgagcttccaaattattgttttccactaaatggacagggaatttcaaacacctacagggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggtcggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctgcgcaacgacaccaacgaccagtccttcaacgactacctgtgcgcagctaacatgctgtaccccatccccgcgaacgccaccagcgtgcccatctctattccctctcgcaactgggcagcttttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggcccggcaacgaccgcctgctaacgcccaacgagttcgaaattaagcgttcggtggacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctgatcggggccaccgccgtacccagcctgacgcagaaaaagttcctctgtgaccgggtgatgtggaggatacccttctctagcaacttcatgtctatgggctccctcaccgacctggggcagaacatgctgtacgccaactccgctcacgccttggatatgacctttgaggtggatcccatggatgagcccacgcttctctatgttttgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcctggaacccgcgtaaccgcacctgctacctgttcgacccttttggtttctccgacgaaaggctgaagcagatctaccaattcgagtacgaggggctcctcaagcgcagcgctctggcctccacgcccgaccactgcgtcaccctggaaaagtccacccagacggtccaggggcccctctcggccgcctgcgggcttttctgttgcatgtttttgcacgccttcgtgcactggcctcacaaccccatggagcgcaaccccaccatggatctgctcaccggagtgcccaacagcatgcttcacagcccccaggtcgcccccaccctgcgccgtaaccaggaacacctgtatcgctttctggggaaacactctgcctatttccgccgccaccggcagcgcatcgagcaggccacggcctttgaaagcatgagccaaagagtgtaataaataaaaaccatttttatttaacatgatacgcgcttctggcgtttttattaaaaatcgaacggttcgagggaggggtcctcgtgcccgctgggaagggacacgttgcggtactggaaacgggcgctccaacgaaactcggggatcaccagccgcggcaggggcacgtcttctaggttctgcttccagaactgccgcaccagctgcagggctcccatgacgtcgggcgccgagatcttgaagtcgcagttagggccggagcccccgcggctgttgcggaacacggggttggcacactggaacaccagcacgctggggttgtaaatactggccagggccgttgggtcggtcacctccgacgcatccagatcctcggcattgctcagggcgaacggagtcagcttgcacatctgccgtccgatctggggcaccaggtcgggtttgttgaggcaatcgcagcgcagagggattaggatgcgacgctgcccgcgttgcatgatagggtaactcgccgccaggaactcctccatctgacggaaggccatctgggccttggtaccctcggtgaaaaatagcccacaggacttgctagaaaatacgttattgccgcagttgatgtcttccgcgcagcagcgtgcatcttcgttcttcagctgaaccacgttacgcccccagcggttctggaccaccttggctttcgtaggatgctccttcaacgcccgctgaccgttctcgctggtcacatccatttccaccacgtgctccttgcagaccatctccactccgtggaagcagaacaggacgccctcctgctgggtattgcgatgctcccaaacggcacatccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagccgctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttggaactccacggtgccgtccgcgcggcgtactctgcgcatcggagggtagctgaagcccacctccaccacggtgccttcgccctcgctgtcggaaacgatctccggggatggcggcggcgcgggtgtcgccttgcgagccttcttcttgggagggagcggaggcacctcctgctcgcgctcggggctcatctcccgcaagtagggggtaatggagcttccgggttggttctgacggttggccattgtatcctaggcagaaagacatggatcttatgcgcgaggaaactttaaccgccccgtcccccgtcagtgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtgcccgaggcgctggccacctaccacatctttttcaaaaaccagcgcattcccctttcctgccgggccaaccgcaccgcagccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccccgaggcggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggagtccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctgctcagcgaaacccaggtcataggtaccttcgagatccagggaccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacttagacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaactctcggagaaaaaagctaaggcctcctctgccgcgaggaaaaactccgccgccgctgccgccgccaaggatccgccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcattgccagcatgagcaaggagattcccaccccttacatgtggagctatcagccccagatgggcctggccgcgggggccgcccaggactactccagcaagatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttttccggctcacctggacgctacccggacgccttcattcccaactttgacgcagtgagtgaatccgtggacggctacgactgatgacagatggtgcggccgtgagagctcggctgcgacatctgcatcactgccgccagcctcgctgctacgctcgggaggcgatcgtgttcagctactttgagctgccggacgagcaccctcaggggccggctcacgggttgaaactcgagatcgagaacgcgctcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaacgaactaattccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatccagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactatgccaatttttttccaagtccagtacaattatgtaaccactggatattccttcaaattcacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgttgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggcgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcagagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccaccaccaaagttcgcccacacccacaaaacccgcgaaaatccagcgccgtcagcacttccgcaatttcagtctcacaacgtcacttccgcgcgccttttccctttcccacacacgcccttcgcccgccccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 252 - DNA, 6078 bp, Artificial Sequence
  Synthetic oligonucleotide RhAdApt64.Empty
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgamytttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgccttatcaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 253 - DNA, 38483 bp, Artificial Sequence
  Synthetic oligonucleotide pWe.RhAd64.pIX-rITR.dE3
taagccttatcaatgtaactttagccatactaagattttgctggaaactgattccttccctcgagtatgttttaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatcccaagctaaccccgataccacttcagaatcttaaataaagacaaacaaatttgttgaaaataaatggctttatttgttttttttggctcggtaggctcgggtccacctgtctcggtcgttaaggactttgtgtatgttttccaaaacacggtacagatgggcttggatgttcaagtacatgggcataaggccatctttggggtgaagataggaccattgaagagcgtcatgctccggggtggtgttgtaaatcacccagtcgtagcagggtttttgggcgtggaactggaagatgtcctttaggagtaggctgatggccaagggcaggcccttagtgtaggtgtttacaaagcggttaagctgggagggatgcatgcggggggagatgatatgcatcttggcttggattttgaggttagctatgttaccacccaggtccctgcgggggttcatgttatgaaggaccaccagcacggtgtagccggtgcacttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtgggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacaaaggtgattggcttgtaagtgtaggtcacgtgacccgcacccccccaaggggtataaaagggggcgtgcccactctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttttcggcccggtagaggatctgcctgaagatggcgtgggagttggaagagatggtggggcgttggaagacgttaaagttggctccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgtctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccataacggaccagttgacgacttgcatgccgggttgggtaatctccgtgtacttgaggcgcgagtaggcgcgggactcgaacacgtagtcgttgcatgtgcgtaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggctgcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgcctcaccacggacgtgaaggaggcgctggctcagaaggagcgctttctgagggacagcaatctgggttctctggtggcactcaacgccttcctgagcacgcagccggccaacgtgccccgcgggcaggaggactacgtgagcttcattagcgctctgaggctgctggtgtccgaggtgccccagagcgaggtgtatcagtccggaccggattacttttttcagacgtcccgccagggcttgcaaacggtgaacctgactcaggcctttaaaaacttgcaaggtatgtggggcgtcaaggccccggtgggcgatcgcgccaccatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagtcgggctctgggtcaggaagacaccggcagcttggaagccacgttgaactttttgctgaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcctcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaacccaacagccccgatacgagtggtttgagtttactattccagagggcaactactccgagaccatgactatcgatctaatgaataacgcgatcgtggacaattacctgcaagtggggaggcagaacggggtattggaaagcgatatcggtgtgaaatttgataccagaaacttccgactggggtgggatcccgtgaccaagctggtgatgccaggcgtgtacaccaacgaggcttttcaccccgacatcgtgctgcttccggggtgtggtgtggactttactcagagccgcttgagtaacctgttaggaatcaggaagcgccgtcccttccaggagggctttcaaatcatgtatgaggacctggagggaggtaacattccaggcttgctagacgtgccggcgtatgaacaaagcttacagcaagcccaagaggaggggcgagtaactcgcggagacacctttgctacggctccccatgagttggtgattcagcctttaacgaaagacagtaaaaacagaagttacaaccttatacccaactctacggatacactgtaccggagctggttcctggcttacaactacggcgatcccgagaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtccaccgcgcttacccacgtgttcaatcgctttcccgagaaccagattttggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctcgggccgaacggcggtagacgataccatagatgccgtgattgccgacgcccgccggtacaatcccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgcctccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcgacgcagggttcaatggaaagggcggcgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaatttgcctacggaaagcgttcgcgtcgcgaagacctggccatcgctttagacagcggcaaccccacgcccagcctcaaacctgtgacgctgcagcaggtgctccccgtgagcgccagcacggacagcaagaggggaataaaaagagaaatggaagatctgcagcccaccatccagctcatggtccctaaacggcagaggctggaagaggtcctggagaaaatgaaagtggaccccagcatagagccggacgtcaaagtcaggccgatcaaagaagtggcccctggtctcggggtgcagacggtggatatccagatccccgtcacgtcagcttcgaccgccgtggaagccatggaaacgcaaacggaaacccctgccgcgatcggtaccagggaagtggcgttgcaaaccgacccctggtacgaatacgccgcccctcggcgtcagaggcgacccgctcgttacggccccgccaacgccatcatgccagaatatgcgctgcatccgtctatcctgcccacccccggctaccggggagtgacgtatcgcccgtcaggaacccgccgccgaacccgtcgccgccgccgctcccgtcgtgctctggcccccgtgtcggtgcgccgcgtaacacgccggggaaagacagttaccattcccaacccgcgctaccaccctagcatcctttaatgactctgccgttttgcagatggctctgacttgccgcgtgcgccttcccgttccgcactatcgaggaagatctcgtcgtaggagaggcatggcgggtagtggtcgccggcgggctttgcgcaggcgcatgaaaggcggaattttacccgctctgatacccataatcgccgccgccatcggtgccatacccggcgtcgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaatggggtggtgaccggcatccacggcgcggtagatctcgccaaccaagcggtgcagaaagagattgacaggcgtttggaaagctcgcgggtgccgccgcagagaggggatgaggtggaggtcgaggaagtagaagtagaggaaaagctgcccccgctggaaaaagttcccggtgcgcctccgagaccgcagaagcggcccaggccagaactagaagagactctggtgacggagagcaaggaacctccctcgtacgagcaagccttgaaagagggcgcctctccaccctcctacccgatgactaagccgatcgcacccatggctcgaccggtgtacggcaaggattacaagcccgtcacgctagagctccccccaccgcccccttcgcgtccgacggtgcctccgctgcctgccccgtcggcgggtcccgtgtctgcaccatccgctgtgcctctgccggccgcccgtcccgtggccgtggccactgccagaaaccccaaaggccagagaggagccaactggcaaagcacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagctttaagccctactccggaaccgcttacaactccctggctcccaagggtgctcccaaccctgcagaatgggaaaattctgacaacaagctaaaagtgagggctcaggcgccttttgttagctcttacggtgccactgcaattacaaaggatggtattcaagttggagtagtattaacagactcgacacagacgccacagtatgcggataaaacgtatcagcctgagccgcaaattggggaactacagtggaacagcgaagtgggaaacgatgataaagtagcaggcagggttctaaagaaaacaacacctatgtttccttgttacggttcatatgccaagcctaccaacgacaaaggagggcaggcaacacagcccgctgctggtcaagacgctcagaatgcagtagaattacagttctttgctactactagcgccaccaccactccaaaagcggtgttatacgctgaggatgtgtccattgaaacaccagacacccaccttgtgttcaagccaacagtaactgcgggaactacaagttcagaagctttgctgtcccaacaagccgctcccaaccgaccaaactacattgccttcagagataactttatcggccttatgtactacaacagcacgggaaacatgggagtactggccggtcaggcatcccagttaaatgccgtggttgatttgcaagacagaaatactgaactgtcatatcagctaatgttggacgcgctgggagaccgcagtcgctacttctctatgtggaaccaagctgttgacagttacgatccagatgtgagaatagtggaaaatcacggcgtagaagatgaattgccaaattattgctttccattgggcggaacggtagttacggatacctacacgcccatacagccaaatagcaatggaggaggcacatgggttgcaaaagataacgtttttacagatagaggagtggaaataagctcaggtaatatgtttgccatggaaattaacctacaagccaacctctggcgcagctttttgtattccaatattggattgtacctcccagacaccctgaaaataacccccgacaacattacgctgccagagaacaaaaacacctaccagtacatgaacggacgggtaacgccgcccggactcgtggacacctacgttaacgtgggcgcgcgctggtcccccgatgtcatggacagcatcaaccccttcaaccaccaccgcaacgccgggctccgctaccgttccatgctccttggcaacggccgctacgtgcccttccacattcaggtgcctcagaaattctttgccattaagaacctgttactgctccccggttcctacacctacgagtggaacttccgcaaggacgttaatatgatcttgcagagctcgctgggcaatgacctgcgagtggacggggcgagcatccgcttcgacagcattaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcgtcggtcagctggcccggcaacgaccgtctgctgacgcccaacgagttcgaaatcaagcgttcggtggacggtgaagggtacaacgtggcccagagcaacatgaccaaggactggttcttaattcagatgctcagccattacaacatcggctaccagggtttctacgtgcccgagaattacaaagaccgcatgtactccttctttagaaacttccaacctatgagccgtcaagtagtagatactgtggcttataaggactactatcaggacgttaagctcccctaccagcacaacaactcagggttcgtgggctacatgggacctaccatgcgagaggggcaggcctaccccgccaactacccctatcccctgattggggccaccgccgtgcccagcctcacgcagaagaagttcctctgcgaccgggtgatgtggaggatccccttctctagcaactttatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggctttatgtccccccacaagccggcctgcgccatcgttaacacggccggacgggagaccgggggggtgcactggctcgccttcgcttggaacccgcgcaaccgcacctgctacctgtttgacccttttgggttttccgacgaaaggctgaagcagatctaccagttcgagtacgaggggctccttaagcgcagcgctctggcttccaccccagaccactgcgtcaccctggaaaagtccacccagacggtccaggggcccctctcggccgcctgcgggctcttctgttgcatgtttctgcacgccttcgtgcactggcctcacacccccatggatcacaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgagcaggccacggcctttgaaagcatgagccaaagagtgtaatcaataaaaccatttttatttaacatgatacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccagaactgccgcaccagctgcagggctcccatcacgtcgggcgccgatatcttgaagtcgcagttagggccggagctcccgcggctgttccggaacacggggttggcacactggaataccatcacgctggggttgtggatactagccagggccgtcggatcggtcacctccgacgcatccagatcctcggcgttgctcagggcgaacggggtcagcttgcacatctgccgcccgatctggggcaccaggtcgggtttgttgaggcaatcgcagcgcagagggatcaggatgcgacgctgcccgcgttgcatgatagggtaactcgccgccaggaactcctccatctgacggaaggccatttgggccttggtgccctcggtgaaaaatagcccacaggacttgctagaaaatacgttattgccgcagttgatgtcttccgagcagcagcgtgcatcttcgttcttcagctgaaccacattacgcccccagcggttctggaccaccttggctttcgtaggatgctcctttaacgcccgctgaccgttctcgctggtcacatccatttccaccacgtgctccttgcagaccatctccactccgtggaagcagaacaggacgccctcctgccgggtattgcgatgctcccatacggcgcatccggtgggctcccagctcttgcgtttcacccccgcgtatgcttccatgtaagccatgaggaatctgcccatcagctcggtgaaggtcttctggttggtgaaggtgagggacaggccgcgatgctcctcgttcaaccaagtttgacagatcttgcggtacacggctccctggtcgggcaaaaacttaaaagccgctcggctgtcgttgtccacgtggaacttctccattaacatcatcatggtttccatacccttctcccacgctgacaccagcggcttgctgtcggggttcttcaccaacacggcggtagaggggccctcgccggccccgacgtccttcatggacattctttgaaactccacggagccgtccgcgcggcgtactctgcgcataggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcgggactcatctcccgcaagtagggggtgatggagcttcctgcttggttctgacggttggccattgtatcctaggcagaaagacatggagcttatgcgcgaggaaactttaaccgccccgtcccccgtcagcgacgaagaggtcatcgtcgaacaggacccgggctacgttactccgcccgaggatctggaggggcccttagacgaccggcgcgacgctagtgagcggcaggaaaatgagaaagaggaggcggagggctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgccccgagtgcctccgaagagacagcccaacggcacctgcgagcccaacccgcggctcaacttctaccccgtgttcgccgtgcccgaggcgctggccacctaccacatctttttcaaaaaccagcgcatccccctctcctgccgggccaaccgcaccgcggccgataggaagctcagacttaaaaacggagccgacatacctgatatcacgtcgctggaggaggtgcccaagatcttcgagggtctgggtcgagatgagaagcgggcggcgaacgctctgcagaaagaacagaaagagaatcagaacgtgctggtggagctggagggggacaacgcgcgtctggccgtcctcaaacgctgcatagaagtctcccacttcgcctaccccgccctcaacttgccgcccaaagttatgaaatcggtcatggatcagctgctcatcaagagagctgagcccctggatcccaaccaccctgaggcggaaaactcagaggacggaaagcccgtcgtcagcgacgaggagctcgagcggtggctggagaccagggacccccagcagttgcaagagaggcgcaagatgatgatggcggccgtgctggtcaccgtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggtgtgtggcagcagtgcttggaagagagaaacctcaaagagctggacaaactcctctaccgccagcggcgggccctctggaccggcttcagcgagcgcacggtcgcctgcgccctggcagacatcattttcccagaacgcctgatgaaaaccttgcagaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccacccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaacccacgtcatcgtcagcatgagcaaggagattcccaccccctacatgtggagctatcagccgcagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcccagttggcccgccgcccaggtgtatcaggaaactccccgcccgaccacagtcctcctgccacgcgacgcggaggctgaagtcctcatgactaactctggggtacaattagcgggcgggtccaggtacgccaggtacagaggtcggaccgctccttactctcccgggagtataaagagggtgatcattcgaggccgaggtatccagctcaacgacgaggcagtgagctcctcaaccggcctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactcggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatccagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgttgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggcgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcagagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccaccaccaaagttcgcccacacccacaaaacccgcgaaaatccagcgccgtcagcacttccgcaatttcagtctcacaacgtcacttccgcgcgccttttccctttcccacacacgcccttcgcccgccccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaat

SEQ ID NO: 254 - DNA, 6085 bp, Artificial Sequence
  Synthetic oligonucleotide RhAdApt65.Empty
catcatcaataatataccttattctggaaacgtgccaatatgataatgagcggggaggagcgaggcggggccggggtgacgtgcggtgacgcggggtgacgcggggtggcgcgagggcggggcgggcgaagggcgtgtgtggggaggcgcttagtttttacgtatgcggaaggaggttttataccggaagttgggtaatttgggcgtatacttgtaagttttgtgtaatttggcgcgaaaaccgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagacctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtaaggtgaggggcggagccacaaagggtataaaggggcatgaggggcgggcgcggtgtttcaaaatgagcggaacgacggacggcaacgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgaggccatctttggggtggagataggaccattgaagagcgtcatgctccggggtggtgttgtaaatcacccagtcgtagcagggtttctgggcgtggaactggaagatgtccttcaggagcaggctgatggccaggggtagacccttagtgtaggtgtttacaaagcggttgagctgggagggatgcatgcggggggagatgatatgcatcttggcttggattttgaggttagctatgttaccacccaggtccctgcgggggttcatgttatgaaggaccaccagcacggtgtagccggtgcatttggggaacttgtcatgcagtttggaggggaaggcgtggaagaatttggagacccccttgtgcccccctaggttttccatgcactcatccataatgatggcaatgggacccctggcggccgctttggcaaacacgttttggggattggaaacatcatagttttgctctagagtgagctcatcataggccatcttcacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagtttagagaggaacagctgccgtcggggcgcaggaggggggctacctcattcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttttgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggccccgcactgagcgcagacggtttcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtatccccgtacaccgacttgagggggcgatcttccaaaggcgttccgaggtcttccgcgtacaggaactgggaccactccgagacgaaggctctggtccaggctaacacgaaggaggcgatctgcgaggggtatctgtcgttttcaatgaggttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 255 - DNA, 38385 bp, Artificial Sequence
  Synthetic oligonucleotide pWe.RhAd65.pIX-rITR.dE3
gacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtaaggtgaggggcggagccacaaagggtataaaggggcatgaggggcgggcgcggtgtttcaaaatgagcggaacgacggacggcaacgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgaggccatctttggggtggagataggaccattgaagagcgtcatgctccggggtggtgttgtaaatcacccagtcgtagcagggtttctgggcgtggaactggaagatgtccttcaggagcaggctgatggccaggggtagacccttagtgtaggtgtttacaaagcggttgagctgggagggatgcatgcggggggagatgatatgcatcttggcttggattttgaggttagctatgttaccacccaggtccctgcgggggttcatgttatgaaggaccaccagcacggtgtagccggtgcatttggggaacttgtcatgcagtttggaggggaaggcgtggaagaatttggagacccccttgtgcccccctaggttttccatgcactcatccataatgatggcaatgggacccctggcggccgctttggcaaacacgttttggggattggaaacatcatagttttgctctagagtgagctcatcataggccatcttcacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagtttagagaggaacagctgccgtcggggcgcaggaggggggctacctcattcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttttgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcggacgagtaggcgtcggccccgcactgagcgcagacggtttcgcactccaccagccacgtgagctcgggtttggcgggatcaaaaaccaagttgccaccattttttttgatgcgtttcttaccttgcgtctccatgagtctgtgtcccgcttccgtgacaaaaaggctgtcggtatccccgtacaccgacttgagggggcgatcttccaaaggcgttccgaggtcttccgcgtacaggaactgggaccactccgagacgaaggctctggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgatccgcaccccccaaaggggtataaaagggggcgtgcccaccctccccgtcactttcttccgcatcgctgtggaccagagccagctgttcgggtgagtaggccctctcaaaagccggcatgatctcggcgctcaagttgtcagtttctacaaacgaggtggatttgatattcacgtgccccgcggcgatgcttttgatggtggaggggtccatctgatcagaaaacacgatctttttattgtcaagtctggtggcgaaagacccgtagagggcgttggaaagcaacttggcgatggagcgcagggtctgatttttctcccgatcggccctctccttggcggcgatgttgagttgcacgtactcgcgggccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatctccccccttttctggagcagaacggaggcaggggatctagcaagttggcgggcggggggtcggcgtcgatggtgaagatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccattggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccacgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgagcggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggctgcagcaacgctaggtcggccacgaccctctcggccagcacggcctgttggatctgcgtgagggtggtctggaagtcgtccaggtccacgaagcggtgataggcccccgtgttgatggtgtaggtgcagttggccataacggaccagttgacgacttgcatgccgggttgggtgatctccgtgtacttgaggcgcgagtaggcgcgggactcgaacacgtagtcgttgcatgtgcgcaccagatactggtagccgaccaggaagtgaggaggcggttctcggtacaggggccagccaacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggatctgattaacatcctgcagagcatcgtggtgcaggagagggggctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggcggcgggttatcccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgcctcaccacggacgtgaaggaggcgctggctcagaaggagcggtttctgagggacagcaatctgggctctctggtggcactcaacgccttcctgagcacgcagccggccaacgtgccccgcgggcaggaggactacgtgagcttcattagcgctctgaggctgctggtgtccgaggtgccccagagcgaggtgtatcagtccggaccggattacttttttcagacgtcccgacagggcttgcaaacggtgaacctgactcaggcctttaaaaacttgcaaggtatgtggggcgtcaaggccccggtgggcgatcgcgccaccatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagattactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgggagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggctaatcgccgattccagaagaaggagggcggagacgagctccccctctccagcgtggaagcggcctcaaggggagagagtccctttcccagtctgtcttccgccagtagcggtcgggtcacgcgcccacggttgccgggggaaagcgactacctgaacgaccccttgctgcgaccggctagaaagaaaaatttccccaacaacggggtggaaagcttggtggataaaatgaatcgttggaagacctacgcccaggagcagcgggagtgggaggacagtcagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggccaggctgatggttaaaaaggtagaaaaccagcctcccgagtacgaatggtttgagttcaccatccccgagggcaactattccgagactatgactatcgatctgatgaacaatgcgatcgtggacaattacctgcaagtggggaggcagcacggggtgctggagagcgatatcggcgtaaaatttgataccagaaacttccgactggggtgggatcccgtgaccaagctggtgatgccaggcgtgtacaccaacgaggcttttcaccccgacatcgtgctgctgccggggtgcggtgtggacttcactcagagccgcttgagtaacctgttaggaatcaggaagcgccgtcccttccaggagggctttcaaatcatgtatgaggatctggagggaggcaacattcccgccctactggacgtgtcaaagtatgaggacagcgtgaagaaggcggaagctcagggacgagaaattcggggcgacacatttgcggtggcaccccaagacctggtgatagagcctttgactaaagacagcaaaaacagaagctacaacattattaccggtactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaagtcagcaacttcccggtggtgggcaccgagctgctgcccgtccatgccaagagcttctacaacgaacaggccgtctactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctcgggccgaacggctgtagacgataccatagatgccgtgattgccgacgcccgacggtacaatcccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagagccgtgctgagacgggcccggagggtaggcagaagggctatgcgccgcgccgccgccaacgccgccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagatcggagaattcgcctatggaaagcgctcgcgtcgcggagacttggccatcgctttagacagcggcaatcccacacccagcctcaaacccgtgacgctgcagcaggtgctccccgtgagcgccagcacggacagcaagaggggaataaaaagagaaatggaagatctgcagcccaccatccagctcatggtccctaaacggcagaggctggaagaggtcctggagaagatgaaagtggaccccagcatagagccggacgtcaaagtcaggccgatcaaagaagtggcccctggtctcggggtgcagacggtggatatccagatccccgtcacgtcagcttcgaccgccgtggaagccatggaaacgcaaacggaaacccctgccgcgatcggtaccagggaagtggcgttgcaaaccgacccctggtacgaatacgccgcccctcggcgtcagaggcggcccgctcgttacggccccgccaacgccatcatgccagaatatgcgctgcatccgtctatcctgcccacccccggctaccggggagtgacgtatcgcccgtcaggaacccgccgccgaacccgtcgccgccgccgctcccgtcgcgctctggcccccgtgtcggtgcggcgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataattgccgccgccatcggtgccatacccggcgtcgcttcagtggccttgcaagcagctcgtaataaataaacgaaggctttttgcacttatgacctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaacggggtggtgaccggcatccacggcgcggtagatctcgccaaccaagcggtgcagaaagagattgacaggcgtttggaaaactcgcgggtgccgccgcagaggggggatgaggtggaggtcgaggaagtagaagtagaggaaaagctgccccccctggagaaagttcccggtgcgcctccgagaccgcagaagcggcccaggccagaactagaagagactctggtgacggagagcaaggagcctccctcgtacgagcaagccttgaaagagggcgcctctccaccctcctacccgatgactaagccgatcgcacccatggctcgaccggtgtacgggaaggactacaagcctgtcacgctagagctccccccgccgccaccaccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggggtgaaaagcctgaaacgccgccgttgctattattaaaaagtgtagctaaaaaatttcccgttgtatacgcctcctatgttaccgccagagacgcgtgactgtcgccgcgagtgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggatcgctcgcagaggctgaccctgcgcttcgtgcccgtagaccgggaggacaccgcgtactcttacaaagtgcgctacacgctggccgtaggggacaaccgggtgctcgacatggccagcacctactttgacatccggggggtgctcgatcgcggtcccagcttcaagccctattcggggaccgcctacaactccctggctcccaagggcgcccccaaccccgctgaatgggcagattctgacagcaaactgaaagtgagggcacaggcaccttttgtcagctcctacggtaataatgcgattacaaaggaaggtattcaggtaggagtaattttaacagactccggacaaacagcacaatatgcggacaaaacgtatcagcctgagccgcagattggagaactacagtggaacagcgaagtaggaaccaatgataaagtagcgggaagggtgcttaagaagacgactccaatgtttccctgttatggttcatacgccaagcctaccaatgcaaaaggagggcaggcgacacagcctgctagtcaagaaactcaaaatccagaattgcagttttttgctgcttccagcaccgtcaacactccaaaagcagtattatacgcagaggacgtgtctattgaagctccagacactcacctggtatttaaaccatcagtaactgaaggaactacaagttcggaagctctactggcacaacaagctgcccctaacaggccaaactatattgcctttcgggacaattttattggcctaatgtattacaatagcactggaaacatgggagtgctggccggacaggcgtcgcaactcaatgcggtggtcgatttgcaagacagaaacacagaactgtcataccagctaatgcttgacgctctgggagatagaagtcgctacttctctatgtggaatcaagccgtggacagttacgatccagatgttagaatagtggaaaatcacggcgtcgaagatgaattgcctaattactgcttccctttgggcggtatggcagtgactgacacctactcgcctataaagcttaatggtgggcaaaacggatgggaagctaataatgacgtttatgccgaaagaggagtggaaataggctcagggaacctgttcgctatggagatcaacctgcaggccaacctgtggcgcagtttcttgtattccaacatcgggctgtacctcccggacactctcaaaatcactcccgacaacatcacgctgccggagaacaagaacacctaccagtacatgaacggtcgcgtgactccccccgggctcgtggacacctacgtcaacgtgggtgcgcgctggtcccccgatgtcatggacagcatcaaccccttcaaccaccaccgcaacgcggggctgcggtaccgttccatgctgctgggcaacggtcgctacgtgcccttccacatccaagtgccccagaaattctttgccatcaagaacctgctgctgctgcccgggtcctacacctacgagtggaacttccgcaaggacgtcaacatgatcctgcagagttccctcggcaacgacctgcgggtggacggggccagcatccgcttcgacagcattaacctctacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggtttgacccctacttcgtctactccggctccatcccctacctggacggcaccttctacctcaaccatactttcaaaaaggtgtcaatcatgttcgactcctcggtcagctggcccggcaacgaccgtctgctgacgcccaacgagttcgaaatcaagcgttcggtggacggtgaagggtacaacgtggctcagagcaacatgaccaaggactggttcctgattcagatgctcagccactacaacatcggctaccagggcttctacgtgcccgaaaattacaaggaccgcatgtactctttcttcagaaacttccaacccatgagccgccaaattgtagattcaacggcttacactaattatcaggatgtgaaactgccataccagcataacaactcagggttcgtgggctacatgggacctaccatgcgagaggggcaagcctaccccgccaactacccctatcccctgattggggccaccgccgtgcccagcctgacgcagaagaagttcctctgcgaccgggtgatgtggaggatccccttctctagcaacttcatgtctatgggctccctcaccgacctggggcagaacatgctgtacgccaactccgctcacgccttggatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccgatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggagacagggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttatttgacatgatacgcgcttctggcgtttttattaaaaatcgaagggttcgagggaggggtcctcgtgcccactggggagggacacgttgcgatactggaaacgggcgctccaacgaaactcggggatcaccagccgcggcaggggcacgtcttctaggttctgcttccaaaactgccgcaccagctgcagggctcccatgacgtcgggcgccgagatcttgaagtcgcagttagggccggagctcccgcggctgttgcggaacacggggttggcacactggaacaccagcacgccggggttgtggatactggccagggccgtcgggtcggtcacctccgacgcatccagatcctcggcgttgctcagggcaaacggggtcagcttgcacatctgccgcccgatctggggtactaggtcgcgcttgttgaggcagtcgcagcgcagagggatcaggatgcgtcgctgcccgcgttgcatgatagggtaactcgccgccaggaactcctccatttgacggaaggccgtttgggctttggcgccctcggtgtagaatagcccgcaggacttgctagagaatacgttatgaccgcagttgacgtcctccgcgcagcagcgggcgtcttcgttcttcagctgaaccacgttgcggccccaacggttctggaccaccttggctctagtggggtgctccttcagcgcccgctgaccgttctcgctggttacatccatttccaacacgtgctccttgcagaccatctccactccgtggaagcagaacaggacgccctcctgctgggtactgcgatgctcccatacggcacatccggtgggctcccagctcttgtgttttacccccgcgtaggcttccatgtaagccatgaggaatctgcccatcagctcggtaaaggtcttctgattggtgaaggtcagcggcaggccgcggtgctcctcgttcaaccaagtttgacagatcttgcggtacacgactccctggtcgggcagaaacttaaaagcccctctgctctcgttgtccacgtggaacttctccatcaacatcgtcatgacttccatgcccttctcccacgccgtcaccaacggttcggtcccggggttcttcaccaacacggcggtggaggggccctcgccggccccgacgtccttcatggtcattctttgaaactccacggagccgtccgcgcgacgtactctgcgcaccggagggtagctgaagcccacctccaccacggtgccttcgccctcgctgtcggagacaatctccggggatggcggcggcggcgcgggtgttgccttgcgagccttcttcttgggagggagcggaggcacctcctgctcgcgctcggggctcatctcccgcaagtagggggtgatggagctgcctgcttggttctgacggttggccattgtatcctaggcagaaagacatggagcttatgcgcgaggaaactttaaccgccccgtcccccgtcagcgacgaagaggtcatcgtcgaacaggacccgggctacgttacgccgcccgaggatctggagtcccccttagacgaccgacgcgacgctagtgagcggcaggaaaatgagaaagaggaggaggagggctgctacctcctggaaggcgacgtcttgctaaagcatttcgccaggcagagcaccatactcaaggaggctttgcaagaccgctccgaggtgcccttggacgtcgccgcgctctcccaggcctacgaggcgaaccttttctcgccccgagtgcctccgaagagacagcccaacggcacctgcgagcccaacccgcgactcaacttctaccccgtgttcgccgtaccagaggcgctggccacctatcacatttttttcaaaaaccaacgcatccccctctcgtgccgggccaaccgcaccgcggccgataggaatctcaggcttaaaaacggagccgacatacctgatatcacgtccttggaggaggtgcccaagattttcgaaggtctgggtcgagatgagaagcgggcggcgaacgctctgcagaaagaacacaaagaaagtcagaacgtgctggtggagctggagggggacaacgcgcgtctggccgtcctcaagcgctgcatagaagtttcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctggggcagagcgtgctgcactgcaccttgcaaggcgaggcgcggagggactacgtccgagactgcgtctacctcttcctcaccctcacctggcagaccgccatgggcgtgtggcagcagtgcttggaagagagaaacctcaaagagctggacaaactcctctgccgccagcggcgggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctcttttgtcctggagcgctccgggatcttgcccgccatgagctgcgcgctaccttctgactttgtccccctctcctaccgcgagtgccctccccccctgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtacccgaggactaccacgcccacaaaattcagttttacgaagaccaatctcgaccaccgaaagcccccctcacggcctgcgtcatcacccagagcaagatcctggcccaattgcaatccatcaaccaagcgcgccgagatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgtcagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgttccctccgtctacttcaacccgttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaagcgatcgtcttcagctactttgagctgccggacgagcaccctcagggaccggctcacgggttgaaactcgagatcgagaacgcgctcgagtctcacctcatcgacgccttcaccgcccgacctctcctggtggaaaccgaacgcgggatcactaccatcaccctgttctgcatctgccccacgcccggattacatgaagatctgtgttgtcatctttgcgctcagtttaataaaaactgaactttttgccgcaccttcaacgccacgcgtcgttcctcaagaaaccaccagcttctctccctatagaggtatcatacaaactgtttactttgacaactctactactctcctaaccctcaactgctcttgctctaggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcgaccgcaaacccactccttcttcaaaataacacactgagtctcatttccagcgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacatgaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatccatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggagccctgcttaacatgactcaaacctctgtcacaatcgagttcacatttgataatactgggtcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccgattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggcaattctttagggttgcaagtgtccgagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttaacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgaaccctcagttactattattttacactttaatgacaatggcgtacgtattaactatccaactttggataatcaaggcaccctaggaagagactctacctggggatatagacaaggtcaatcagccaacactaatgttactaatgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaattcacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgttgtgagtcagtccggtatttgggagttaaaatccaaacagtctctttggtgatgagacatcgatccgtgatggacacaaatccctgggacaggttctccaacgtttcggtgaaaaactgcgcgccgccctacaaaacaaacaggttcaggctctccacgggttatctccccgatcaaactcagacaaggtaaaggtgcgatgatgttccactaaaccacgcaggtggcgctgtctgaacctctcggtgcgactcctgtgaggctgataggaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgcccgtccaaccttactttaacataaatcaggtgtctgccgcgtacaaacatactacccgcatacagaacttcccggggcaaacccctgttcaccacctgcctgtaccagggaaacctcacatttatcagggaaccatagatagccattttaaaccaattagctaacaccgccccaccagctctacactgaagagaaccgggagagttacaatgacagtgaataatccatctctcataacccctgatagtctgatggaaatccagatctaacgtggcacaacagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagttctcctctacaacagcactgccgcggtcctcacaaggtggtagctggtgacgattgtagggagccagtctgcagcgataccgtctgtcgcgttgcatcgtagaccagggaccgacgcacttcctcgtacttgtagtagcagaaccacgtccgccgccagcacgtctccaagtaacgccggtccctgcgtcgctcacgctccctcctcaacgcaaagtgcaaccactcttgtaatccgcacagatccctctcggcctccggggcgatgcacacctcaaacctacagatgtctcggtacagttccaaacacgtagtgagggcgagttccaaccaagacagacagcctgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcactagaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacagcaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcagagacagcaaaacaatccctctgggagcaatcacaaaatcctccggtgaaaaaagcacacacatattagaataaccctgttgctggggcaaaaaggcccgtcgtcccagcaaatgcacataaatatgttcatcagccattgccccgtcttaccgcgtaaacagccacgaaaaaatcgagctaaaatccacccaacagcctatagctatatatacactccgcccaatgacgctaataccgcaccacccaccaccaaagttcgcccacacccacaaaacccgcgaaaatccagcgccgtcagcacttccgcaatttcagtctcacaacgtcacttccgcgcgccttttttcgctattcccacacccgccccgccctcgcgccaccccgcgtcaccccgcgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 256 - DNA, 6080 bp, Artificial Sequence
  Synthetic oligonucleotide RhAdApt66.Empty
catcatcaataatataccttattttggaaacgtgccaatatgataatgagcgaggcggggccggggtgacgcgagggtgacgcggggtggcgcgagggcgaggcgggtgtggggaggcgcttagtttttacgtatgcggaaggaggttttataccggaagttgggtaatttgggcgtttacttgtaagttttgtgtaatttggcgcgaaaaccgggtaatgaggaagtagaggttaatatgtactttttatgactgggcggaatttctgctgatcagcagtgaactttggccgctgacggggaggtttcgctacgtggcagtaccacgagaaggctcaaaggtcccatttattgtactcctcagcgttttcgctgggtatttaaacgctgtcagatcatcaagagaccactcttgagtgccggcgagtagagttttctcctccgcgctgccgcgatgaggccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctacgtaccgactatgaatccagcgatgaggagtgaggtgaggggcggagccacaaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtggcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgagaccatctttggggtggagataggaccactgaagagcgtcatgctccggggtggtgttgtaaatcacccagtcgtagcagggtttctgggcgtggaactggaagatgtccttcaggagcaggctaatggccaggggtagacccttagtgtaggtgtttacaaagcggttgagctgggagggatgcatgcggggggagatgatatgcatcttggcttggattttaaggttagctatgttaccacccaggtccctgcgggggttcatgttatgaaggaccaccagcacggtgtagccggtgcatttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtttgtgtcccgcttccgtgacaaaaaggctgtcggtgtccccgtagaccgacttgagggggcgatcttccaaaggtgttccgaggtcttccgcgtacaggttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 257 - DNA, 5809 bp, Artificial Sequence
  Synthetic oligonucleotide RhAdApt66.v2.Empty
catcatcaataatataccttattttggaaacgtgccaatatgataatgagcgaggcggggccggggtgacgcgagggtgacgcggggtggcgcgagggcgaggcgggtgtggggaggcgcttagtttttacgtatgcggaaggaggttttataccggaagttgggtaatttgggcgtttacttgtaagttttgtgtaatttggcgcgaaaaccgggtaatgaggaagtagaggttaatatgtactttttatgactgggcggaatttctgctgatcagcagtgaactttggccgctgacggggaggtttcgctacgtggcagtaccacgagaaggctcaaaggtcccatttattgtactcctcagcgttttcgctgggtatttaaacgctgtcagatcatcaagagaccactcttgagtgccggcgagtagagttttctcctccgcgctgccgcgatgaggccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatccggtgaggggcggagccacaaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtggcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgagaccatctttggggtggagataggaccactgaagagcgtcatgctccggggtggtgttgtaaatcacccagtcgtagcagggtttctgggcgtggaactggaagatgtccttcaggagcaggctaatggccaggggtagacccttagtgtaggtgtttacaaagcggttgagctgggagggatgcatgcggggggagatgatatgcatcttggcttggattttaaggttagctatgttaccacccaggtccctgcgggggttcatgttatgaaggaccaccagcacggtgtagccggtgcatttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtttgtgtcccgcttccgtgacaaaaaggctgtcggtgtccccgtagaccgacttgagggggcgatcttccaaaggtgttccgaggtcttccgcgtacaggttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 258 - DNA, 38450 bp, Artificial Sequence
  Synthetic oligonucleotide pWe.RhAd66.pIX-rITR.dE3
gccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctacgtaccgactatgaatccagcgatgaggagtgaggtgaggggcggagccacaaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtggcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgagaccatctttggggtggagataggaccactgaagagcgtcatgctccggggtggtgttgtaaatcacccagtcgtagcagggtttctgggcgtggaactggaagatgtccttcaggagcaggctaatggccaggggtagacccttagtgtaggtgtttacaaagcggttgagctgggagggatgcatgcggggggagatgatatgcatcttggcttggattttaaggttagctatgttaccacccaggtccctgcgggggttcatgttatgaaggaccaccagcacggtgtagccggtgcatttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtttgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccaaaggggtataaaagggggcgtgcccaccctccccgtcactttcttccgcatcgctgtggaccagagccagctgttcgggtgagtaggccctctcaaaagccggcatgatttcggcgctcaagttgtcagtttctacaaacgaggtggatttgatattcacgtgccccgcagcgatgcttttgatggtggaggggtccatctgatcagaaaacacgatctttttattgtcaagtttggtggcgaaagacccgtagagggcgttggaaagcaacttggcgatggagcgcagggtctgatttttttcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcggacggggggtcggcgtcgatggtgaagatgccgggtagcagaattttattaaaataatcgatttcggtgtccgtgttttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgcggggtttctcggcccggtagaggatctgcctgaagatggcgtgggagttggaagagatggtggggcgttggaaaacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcatcgaagccgttgatgttgtggcccacgatgtaaagttcgataaagcgcggctgtcccttgagggccggcgcttttttcaactcctcgtaggtgagacagtccggcgaggacagacccagctcagcccgggcccagtcggagagttgaggattagccgcgaggaaggaactccatagatccaaggccaggagagtttgcaagcggtcgcggaactcgcggaactttttgcccacggccattttctccggcgttaccacgtaaaaggtgtcggggcggttgttccagacgtcccatcggagctctagggccagctcgcaggcttggcgaacgagggtctcctcgcccgagacgtgcatgaccagcatgaagggtaccaactgtttcccaaacgagcccatccatgtgtaggtttctacgtcgtaggtgacaaagagccgctgggcgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagactggggcttggtggggcggcatccccttcgccttggcggtgggagtctgcgtctgcgcccttcttctctgggtggacgacggtggggaagacgacgccccgggtgccgcaagtccagatctccgccacggaggggcgcaggcgctgcaggagggggcgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtcagcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgtcgcagggtcatctcgttgatgtctccgatggcttcgagacgctccatggcctcgtagaagtcgacggcgaagttgaaaaattgggagttgcgggcggctaccgtgagttcttcttgcaggaggcggatgagatcggcgaccgtgtcgcgtacctcctgttcgaaagcgccccgaggcgcctctacttcttcctccggctcctcctcttccaggggcacaggttcctccgccagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaaaacgccgccgcgcagagcgcccccgtgcagggagggtaagtggttagggccgtcgggcagggacacggcgctgacgatgcattttatcaattgctgcgtaggcactccgtacagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgttcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggccctggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcaggggacggaagcgttccatggtgggcacgctctgccccgtgaggcgggcgcagtcctgtacgctctagatggaaaaaagacagggcggtcatcgactcccttccgtagctcggggggtaaagtcgcaagggtgcggcggcggggaaccccggttcgaaaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgaccccagacgcccaccaccaccgccgcggcggcagtaaacctgagcggaggcggtgacagggaggaggaggagctggctttagacctggaagagggagaggggctggcccgactgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgaaacgttccgcgacgccatgttgaacatcgcggagcccgagggtcgctggctcttggatctgattaacatcttgcagagcatcgtggtgcaggagagggggctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaagtgctgacgctgagcgacgacctcggcgtgtaccgtaacgacaagatccacaaggcggtgagcgccagccgccggcgggagctgagcgacagagagctgatgcacagcctgcagagggcgctggcgggcgccggggacgaggagcgcgaggcttacttcgacatgggagccgatctgcagtggcgtcccagcgcgcgcgccttgaaggcggcgggctaccccgacgaggaggatcgggacgatttggaggaggcaggcgagtacgaggacgaagcctgaccgggcaggtgttgttttagatgcagcggccggcggacggggccaccgcggatcccgcaattttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtaccgtcgcgcaccaacccgacgcacgagaaagtcctgactatcgtaaacgccctggtagacagcaaggctatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggttctctggtggcactgaacgcctttctgagcacgcagccggccaacgtgccccgcgggcaggaggattacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaatttgcaaggcatgtggggcgtcaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgtgtccgacagcattttcacgccggctaatcgccgattccagaagaaggagggcggagacgagctccccctctccagcgtggaagcggcctcaaggggagagagtccctttcccagtctgtcttctgccagtagcggtcgggtaacgcgcccgcggttgccgggggagagcgactacctgaacgaccccttgctgcgaccggctagaaagaaaaatttccccaacaacggggtggaaagcttggtggataaaatgaatcgttggaagacctacgcccaggagcagagggagtgggaggacagtcagccgcgaccgctggttccgccgcactggcgtcgccagagagaagacccggacgactccgcagacgatagtagcgtgttggacctgggagggagcggagccaacccctttgctcacttgcaacccaaagggcgttcgagtcgcctgtactaataaaaaagacgcggaaacttaccagagccatggccacagcgtgtgtcctttcttcctctctttcctcctcggcgcggcagaatgagaagagcggtgagagtcacgccggcggcgtatgagggcccgcccccttcttacgaaagcgtgatgggatcagcgaacgtaccggccacgctggaggcgccttacgttcctcccagatacctgggacctaccgagggcagaaacagcatccgttactccgagctcgcgcccctgtacgataccaccaaggtgtacctggtggacaacaagtcggcggacatcgcctccctgaattaccaaaacgaccacagcaacttcctgactaccgtggtgcagaacaatgacttcaccccgacggaggcgggcacgcagaccattaattttgacgagcgttcccgctggggcggtcagctgaaaaccatcctgcacaccaacatgcccaacatcaacgagttcatgtccaccaacaagttcagggctaagctgatggtagaaaaaattagcggacaacctcccaaatatgaatggttcgagttcaccattcccgagggtaactactccgagaccatgactatcgatctgatgaataacgcgattgtggacaattacctgcaagtggggaggcagaacggggtattggaaagcgatatcggtgtgaaatttgataccagaaacttccgactggggtgggatcccgtgaccaagctggtgatgccaggcgtgtacaccaatgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcggcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaagaggcgctccagtcagcacccagttcgagttcggggccacttccgcgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggagagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgtcacgtcagcttcaaccgccgtggaagccatggaaacgcaaaccgaaacccccgccgcggttggtacgaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacaattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgcgggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgcggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggtacaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaacgcagttgtggacttgcaagacagaaacaccgaattgtcataccagcttatgctcgacgcattgggagacagaagtcgatacttttcaatgtggaatcaagctgtcgacagttacgatccagatgttaggataattgaaaaccacggcgttgaagacgagcttccaaattattgttttccactaaatggacagggaatttcaaacacctacaaggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggccggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctccgcaacgacaccaacgaccagtccttcaacgactacctgtgcgcagctaacatgctgtaccccatccccgcgaacgccaccagcgtgcccatctctattccctctcgcaactgggcagcctttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggccaggcaacgaccgcctgctaacgcccaacgagttcgaaattaagcgttcggtagacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctaatcggggccaccgccgtacccagcctgacgcagaaaaagttcctctgtgaccgggtgatgtggaggatccccttctctagcaactttatgtctatgggctccctcaccgacctggggcagaacatgctgtacgccaactccgctcacgccttggacatgacatttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtctcccccaccctgcgccgtaaccaggaacacctgtatcgctttttggggaaacactctgcctactttcgccgccaccggcagcgcattgaacaggccacggcctttgaaagcatgaaccaaagagtgtaatcaataaaaaccatttttattttaacatgacacgcgcttctggcgttttttattaaaaatcgaagggttcgagggaggtgtcttcgtgcccgctggggagggacacgttgcggtactggaaacgggcgctccaacgaaactcggggatcaccagtcgcggcaggggcacgtcttccaggttctgcttccagaactgccgcaccagctgcagagctcccatcacgtcgggcgccgagatcttgaagtcgcagttagggccggagctcccgcggctgttgcggaacacggggttggcgcactggaacaccagcacgctggggttgtagatactagccagggccgtcgggtcggtcacctccgacgcatccagatcttcggcgttgctcagggcgaacggggtcagcttgcacatctgccgcccgatctggggcaccaggtcggatttgttgaggcaatcgcagcgcagagggatgaggatgcgacgctgcccgcgttgcatgatagggtaactcgctgccaggaactcctccatctgacggaaggccatctgggccttcgtgccctcggtgaaaaagagcccacaggacttgctagagaatacgttattgccgcagttgatgtcttccgagcagcagcgggcgtcttcattcttcagctgaaccacgttgcgaccccagcggttctggaccaccttggctttcgtaggatgctccttcaacgcccgctgaccgttctcgctggtcacatccatttccaccacgtgctccttgcagaccatctccactccgtggaagcagaacaggacgccctcctgccgggtattgcgatgctcccacacagcgcacccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccaaggtgccttcgccctcgctgtcggaaacgatctccggggagggcggcggcgcgggtgttgccttgcgagccttcttcttgggagggagcggaggcacctcctgctcgcgctcggggctcatctcccgcaagtagggggtgatggagcttcctgcttggttctgacggttggccattgtatcctaggcagaaagacatggagcttatgcgcgaggaaactttaaccgccccgtcccccgtcagcgacgaagatgtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatagttaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcgactcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcaaacgctctgcagaaagaacagaaagaaagtcagaacgtgctggtggagctggaaggggacaacgcgcgtctggccgtcctcaaacgttgcgtagaagtttcccacttcgcctaccccgccctcaacctgccgcccaaagttatgaaatcggtcatggaccagctactcatcaagagagctgagcccctggatcccgaccaccctgaggcggaaaactcagaggacggaaagcccgttgtcagcgacgaggagctcgagcggtggctggaaaccagggatccccagcagttgcaagagaggcgcaagatgatgatggcggccgtgctggtcacggtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggcgtgtggcagcagtgcttggaagagagaaacctcaaagagctggacaaactcctctgccgccagcggcgggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctcttttgtcctggagcgctccgggatcttgcccgccatgagctgcgcgctgccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaaaatcctggcccaattgcaatccatcaaccaagcgcgccgagatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttctccctcgggcgccaaaacccacgtcatcgccagcatgagcaaggagattcccaccccttacatgtggagctatcaaccccagatgggcctggccgcgggggccgcccaggactactccagcaaaatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcggccgcaaacccactccttcttcaaaataacacactgagtcttatttccagtgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacataaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatctatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggcgccctgcttaacatgactcaaacctctgtaacaatccagttcacatttgataatactggttcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccaattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggtaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttgacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaagggaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgatgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggtgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcagcagtgggtcgaaatgaagatcccgaagatgacaacggtcgcctccggaaccctggtggaatttaacagccagatcaaacattatacgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcgctaaaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacaacaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcaaagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacaaaaaatcgagctaaaatccacccaacagcctatagctatatatacactccgcccaatgacgctaataccgcaccacccaccaccaaagttcacccacacccacaaaacccgcgaaaatccagcgccgtcagcacttccgcaatttcagtctcacaacgtcacttccgcgcgccttttcccattcccacacacacaaacgccgccctcgcgccaccccgcgtcaccctcgcgtcaccccggccccgcctcgctcattatcatattggcacgtttccaaaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 259 - DNA, 38180 bp, Artificial Sequence
  Synthetic oligonucleotide pWe.RhAd66.v2.pIX-rITR.dE3
aggtgaggggcggagccacaaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtggcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgagaccatctttggggtggagataggaccactgaagagcgtcatgctccggggtggtgttgtaaatcacccagtcgtagcagggtttctgggcgtggaactggaagatgtccttcaggagcaggctaatggccaggggtagacccttagtgtaggtgtttacaaagcggttgagctgggagggatgcatgcggggggagatgatatgcatcttggcttggattttaaggttagctatgttaccacccaggtccctgcgggggttcatgttatgaaggaccaccagcacggtgtagccggtgcatttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtttgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccaaaggggtataaaagggggcgtgcccaccctccccgtcactttcttccgcatcgctgtggaccagagccagctgttcgggtgagtaggccctctcaaaagccggcatgatttcggcgctcaagttgtcagtttctacaaacgaggtggatttgatattcacgtgccccgcagcgatgcttttgatggtggaggggtccatctgatcagaaaacacgatctttttattgtcaagtttggtggcgaaagacccgtagagggcgttggaaagcaacttggcgatggagcgcagggtctgatttttttcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcggacggggggtcggcgtcgatggtgaagatgccgggtagcagaattttattaaaataatcgatttcggtgtccgtgttttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgcggggtttctcggcccggtagaggatctgcctgaagatggcgtgggagttggaagagatggtggggcgttggaaaacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcatcgaagccgttgatgttgtggcccacgatgtaaagttcgataaagcgcggctgtcccttgagggccggcgcttttttcaactcctcgtaggtgagacagtccggcgaggacagacccagctcagcccgggcccagtcggagagttgaggattagccgcgaggaaggaactccatagatccaaggccaggagagtttgcaagcggtcgcggaactcgcggaactttttgcccacggccattttctccggcgttaccacgtaaaaggtgtcggggcggttgttccagacgtcccatcggagctctagggccagctcgcaggcttggcgaacgagggtctcctcgcccgagacgtgcatgaccagcatgaagggtaccaactgtttcccaaacgagcccatccatgtgtaggtttctacgtcgtaggtgacaaagagccgctgggcgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagactggggcttggtggggcggcatccccttcgccttggcggtgggagtctgcgtctgcgcccttcttctctgggtggacgacggtggggaagacgacgccccgggtgccgcaagtccagatctccgccacggaggggcgcaggcgctgcaggagggggcgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtcagcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgtcgcagggtcatctcgttgatgtctccgatggcttcgagacgctccatggcctcgtagaagtcgacggcgaagttgaaaaattgggagttgcgggcggctaccgtgagttcttcttgcaggaggcggatgagatcggcgaccgtgtcgcgtacctcctgttcgaaagcgccccgaggcgcctctacttcttcctccggctcctcctcttccaggggcacaggttcctccgccagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaaaacgccgccgcgcagagcgcccccgtgcagggagggtaagtggttagggccgtcgggcagggacacggcgctgacgatgcattttatcaattgctgcgtaggcactccgtacagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgttcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggccctggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcaggggacggaagcgttccatggtgggcacgctctgccccgtgaggcgggcgcagtcctgtacgctctagatggaaaaaagacagggcggtcatcgactcccttccgtagctcggggggtaaagtcgcaagggtgcggcggcggggaaccccggttcgaaaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgaccccagacgcccaccaccaccgccgcggcggcagtaaacctgagcggaggcggtgacagggaggaggaggagctggctttagacctggaagagggagaggggctggcccgactgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgaaacgttccgcgacgccatgttgaacatcgcggagcccgagggtcgctggctcttggatctgattaacatcttgcagagcatcgtggtgcaggagagggggctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaagtgctgacgctgagcgacgacctcggcgtgtaccgtaacgacaagatccacaaggcggtgagcgccagccgccggcgggagctgagcgacagagagctgatgcacagcctgcagagggcgctggcgggcgccggggacgaggagcgcgaggcttacttcgacatgggagccgatctgcagtggcgtcccagcgcgcgcgccttgaaggcggcgggctaccccgacgaggaggatcgggacgatttggaggaggcaggcgagtacgaggacgaagcctgaccgggcaggtgttgttttagatgcagcggccggcggacggggccaccgcggatcccgcaattttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtaccgtcgcgcaccaacccgacgcacgagaaagtcctgactatcgtaaacgccctggtagacagcaaggctatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggttctctggtggcactgaacgcctttctgagcacgcagccggccaacgtgccccgcgggcaggaggattacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaatttgcaaggcatgtggggcgtcaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgtgtccgacagcattttcacgccggctaatcgccgattccagaagaaggagggcggagacgagctccccctctccagcgtggaagcggcctcaaggggagagagtccctttcccagtctgtcttctgccagtagcggtcgggtaacgcgcccgcggttgccgggggagagcgactacctgaacgaccccttgctgcgaccggctagaaagaaaaatttccccaacaacggggtggaaagcttggtggataaaatgaatcgttggaagacctacgcccaggagcagagggagtgggaggacagtcagccgcgaccgctggttccgccgcactggcgtcgccagagagaagacccggacgactccgcagacgatagtagcgtgttggacctgggagggagcggagccaacccctttgctcacttgcaacccaaagggcgttcgagtcgcctgtactaataaaaaagacgcggaaacttaccagagccatggccacagcgtgtgtcctttcttcctctctttcctcctcggcgcggcagaatgagaagagcggtgagagtcacgccggcggcgtatgagggcccgcccccttcttacgaaagcgtgatgggatcagcgaacgtaccggccacgctggaggcgccttacgttcctcccagatacctgggacctaccgagggcagaaacagcatccgttactccgagctcgcgcccctgtacgataccaccaaggtgtacctggtggacaacaagtcggcggacatcgcctccctgaattaccaaaacgaccacagcaacttcctgactaccgtggtgcagaacaatgacttcaccccgacggaggcgggcacgcagaccattaattttgacgagcgttcccgctggggcggtcagctgaaaaccatcctgcacaccaacatgcccaacatcaacgagttcatgtccaccaacaagttcagggctaagctgatggtagaaaaaattagcggacaacctcccaaatatgaatggttcgagttcaccattcccgagggtaactactccgagaccatgactatcgatctgatgaataacgcgattgtggacaattacctgcaagtggggaggcagaacggggtattggaaagcgatatcggtgtgaaatttgataccagaaacttccgactggggtgggatcccgtgaccaagctggtgatgccaggcgtgtacaccaatgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcggcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaagaggcgctccagtcagcacccagttcgagttcggggccacttccgcgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggagagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgtcacgtcagcttcaaccgccgtggaagccatggaaacgcaaaccgaaacccccgccgcggttggtacgaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacaattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgcgggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgcggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggtacaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaacgcagttgtggacttgcaagacagaaacaccgaattgtcataccagcttatgctcgacgcattgggagacagaagtcgatacttttcaatgtggaatcaagctgtcgacagttacgatccagatgttaggataattgaaaaccacggcgttgaagacgagcttccaaattattgttttccactaaatggacagggaatttcaaacacctacaaggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggccggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctccgcaacgacaccaacgaccagtccttcaacgactacctgtgcgcagctaacatgctgtaccccatccccgcgaacgccaccagcgtgcccatctctattccctctcgcaactgggcagcctttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggccaggcaacgaccgcctgctaacgcccaacgagttcgaaattaagcgttcggtagacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctaatcggggccaccgccgtacccagcctgacgcagaaaaagttcctctgtgaccgggtgatgtggaggatccccttctctagcaactttatgtctatgggctccctcaccgacctggggcagaacatgctgtacgccaactccgctcacgccttggacatgacatttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtctcccccaccctgcgccgtaaccaggaacacctgtatcgctttttggggaaacactctgcctactttcgccgccaccggcagcgcattgaacaggccacggcctttgaaagcatgaaccaaagagtgtaatcaataaaaaccatttttattttaacatgacacgcgcttctggcgttttttattaaaaatcgaagggttcgagggaggtgtcttcgtgcccgctggggagggacacgttgcggtactggaaacgggcgctccaacgaaactcggggatcaccagtcgcggcaggggcacgtcttccaggttctgcttccagaactgccgcaccagctgcagagctcccatcacgtcgggcgccgagatcttgaagtcgcagttagggccggagctcccgcggctgttgcggaacacggggttggcgcactggaacaccagcacgctggggttgtagatactagccagggccgtcgggtcggtcacctccgacgcatccagatcttcggcgttgctcagggcgaacggggtcagcttgcacatctgccgcccgatctggggcaccaggtcggatttgttgaggcaatcgcagcgcagagggatgaggatgcgacgctgcccgcgttgcatgatagggtaactcgctgccaggaactcctccatctgacggaaggccatctgggccttcgtgccctcggtgaaaaagagcccacaggacttgctagagaatacgttattgccgcagttgatgtcttccgagcagcagcgggcgtcttcattcttcagctgaaccacgttgcgaccccagcggttctggaccaccttggctttcgtaggatgctccttcaacgcccgctgaccgttctcgctggtcacatccatttccaccacgtgctccttgcagaccatctccactccgtggaagcagaacaggacgccctcctgccgggtattgcgatgctcccacacagcgcacccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccaaggtgccttcgccctcgctgtcggaaacgatctccggggagggcggcggcgcgggtgttgccttgcgagccttcttcttgggagggagcggaggcacctcctgctcgcgctcggggctcatctcccgcaagtagggggtgatggagcttcctgcttggttctgacggttggccattgtatcctaggcagaaagacatggagcttatgcgcgaggaaactttaaccgccccgtcccccgtcagcgacgaagatgtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatagttaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcgactcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcaaacgctctgcagaaagaacagaaagaaagtcagaacgtgctggtggagctggaaggggacaacgcgcgtctggccgtcctcaaacgttgcgtagaagtttcccacttcgcctaccccgccctcaacctgccgcccaaagttatgaaatcggtcatggaccagctactcatcaagagagctgagcccctggatcccgaccaccctgaggcggaaaactcagaggacggaaagcccgttgtcagcgacgaggagctcgagcggtggctggaaaccagggatccccagcagttgcaagagaggcgcaagatgatgatggcggccgtgctggtcacggtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggcgtgtggcagcagtgcttggaagagagaaacctcaaagagctggacaaactcctctgccgccagcggcgggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctcttttgtcctggagcgctccgggatcttgcccgccatgagctgcgcgctgccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaaaatcctggcccaattgcaatccatcaaccaagcgcgccgagatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttctccctcgggcgccaaaacccacgtcatcgccagcatgagcaaggagattcccaccccttacatgtggagctatcaaccccagatgggcctggccgcgggggccgcccaggactactccagcaaaatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcggccgcaaacccactccttcttcaaaataacacactgagtcttatttccagtgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacataaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatctatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggcgccctgcttaacatgactcaaacctctgtaacaatccagttcacatttgataatactggttcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccaattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggtaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttgacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaagggaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagcctctcccccttcatggcagtaaactgatgtgagtcagtccggtatttgggagttaaaatccaaacagtctctttggtgataagacgtcgatccgtgatggacacaaatccctgggacaggttttccaacgtttcggtgaaaaactgcgtgccgccctacaaaacaaacaggttcaggctctccacgggttatctccccgatcaaactcagacagagtaaaggtgtgatgatgttccactaaaccacgcaagtggcgctgtctgaacctctcggtgcgactcctgtgaggctggtaagaagttagattgtccagtagcctcacagcatggatgatcagtctacgagtgcgtctggcgcagcagcgcatctgaatctcacggagattccggcaagaatcgcacaccatcacaatcaggttgttcataatcccatagctgaacacgctccagccgaagctcattcgctccaacagcgccaccgcgtgcccatccaaccttactttaacataaatgaggtgtctgccgcgtacaaacatactagccgcatacagaacttcccggggcaaacccctgttcaccacctgtctgtaccagggaaacctcacatttatcagtgaaccataaatggccattttaaaccaattagctaacaccaccccaccagctctacactgaagagaaccgggagagttacaatgacagtgaataatccatctctcatagcccctgattacctgatggaaatccagatctaacgtggcacaacagatacacaccctcatatacattttcataacatgtttttcccaggctgttaaaatacaatcccaatacacgggccactcctgcagtacaataaaactaatacaagatggtatactcctcacctcactaacattgtgcatgttcatattttcacattctaagtaccgagagttctcctctacagtggcgctgccgcggtcctcacaaggtggtagctggtaacgatcgtaaggagccagtctgcagcgataccgcctgtcgcgctgcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggtgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcagcagtgggtcgaaatgaagatcccgaagatgacaacggtcgcctccggaaccctggtggaatttaacagccagatcaaacattatacgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcgctaaaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacaacaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcaaagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacaaaaaatcgagctaaaatccacccaacagcctatagctatatatacactccgcccaatgacgctaataccgcaccacccaccaccaaagttcacccacacccacaaaacccgcgaaaatccagcgccgtcagcacttccgcaatttcagtctcacaacgtcacttccgcgcgccttttcccattcccacacacacaaacgccgccctcgcgccaccccgcgtcaccctcgcgtcaccccggccccgcctcgctcattatcatattggcacgtttccaaaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 260 - DNA, 38526 bp, Artificial Sequence
  Synthetic oligonucleotide pWe.RhAd66.pIX-rITR.dE3.5orf6
gccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctacgtaccgactatgaatccagcgatgaggagtgaggtgaggggcggagccacaaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtggcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgagaccatctttggggtggagataggaccactgaagagcgtcatgctccggggtggtgttgtaaatcacccagtcgtagcagggtttctgggcgtggaactggaagatgtccttcaggagcaggctaatggccaggggtagacccttagtgtaggtgtttacaaagcggttgagctgggagggatgcatgcggggggagatgatatgcatcttggcttggattttaaggttagctatgttaccacccaggtccctgcgggggttcatgttatgaaggaccaccagcacggtgtagccggtgcatttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtttgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccaaaggggtataaaagggggcgtgcccaccctccccgtcactttcttccgcatcgctgtggaccagagccagctgttcgggtgagtaggccctctcaaaagccggcatgatttcggcgctcaagttgtcagtttctacaaacgaggtggatttgatattcacgtgccccgcagcgatgcttttgatggtggaggggtccatctgatcagaaaacacgatctttttattgtcaagtttggtggcgaaagacccgtagagggcgttggaaagcaacttggcgatggagcgcagggtctgatttttttcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcggacggggggtcggcgtcgatggtgaagatgccgggtagcagaattttattaaaataatcgatttcggtgtccgtgttttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgcggggtttctcggcccggtagaggatctgcctgaagatggcgtgggagttggaagagatggtggggcgttggaaaacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcatcgaagccgttgatgttgtggcccacgatgtaaagttcgataaagcgcggctgtcccttgagggccggcgcttttttcaactcctcgtaggtgagacagtccggcgaggacagacccagctcagcccgggcccagtcggagagttgaggattagccgcgaggaaggaactccatagatccaaggccaggagagtttgcaagcggtcgcggaactcgcggaactttttgcccacggccattttctccggcgttaccacgtaaaaggtgtcggggcggttgttccagacgtcccatcggagctctagggccagctcgcaggcttggcgaacgagggtctcctcgcccgagacgtgcatgaccagcatgaagggtaccaactgtttcccaaacgagcccatccatgtgtaggtttctacgtcgtaggtgacaaagagccgctgggcgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagactggggcttggtggggcggcatccccttcgccttggcggtgggagtctgcgtctgcgcccttcttctctgggtggacgacggtggggaagacgacgccccgggtgccgcaagtccagatctccgccacggaggggcgcaggcgctgcaggagggggcgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtcagcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgtcgcagggtcatctcgttgatgtctccgatggcttcgagacgctccatggcctcgtagaagtcgacggcgaagttgaaaaattgggagttgcgggcggctaccgtgagttcttcttgcaggaggcggatgagatcggcgaccgtgtcgcgtacctcctgttcgaaagcgccccgaggcgcctctacttcttcctccggctcctcctcttccaggggcacaggttcctccgccagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaaaacgccgccgcgcagagcgcccccgtgcagggagggtaagtggttagggccgtcgggcagggacacggcgctgacgatgcattttatcaattgctgcgtaggcactccgtacagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgttcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggccctggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcaggggacggaagcgttccatggtgggcacgctctgccccgtgaggcgggcgcagtcctgtacgctctagatggaaaaaagacagggcggtcatcgactcccttccgtagctcggggggtaaagtcgcaagggtgcggcggcggggaaccccggttcgaaaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgaccccagacgcccaccaccaccgccgcggcggcagtaaacctgagcggaggcggtgacagggaggaggaggagctggctttagacctggaagagggagaggggctggcccgactgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgaaacgttccgcgacgccatgttgaacatcgcggagcccgagggtcgctggctcttggatctgattaacatcttgcagagcatcgtggtgcaggagagggggctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaagtgctgacgctgagcgacgacctcggcgtgtaccgtaacgacaagatccacaaggcggtgagcgccagccgccggcgggagctgagcgacagagagctgatgcacagcctgcagagggcgctggcgggcgccggggacgaggagcgcgaggcttacttcgacatgggagccgatctgcagtggcgtcccagcgcgcgcgccttgaaggcggcgggctaccccgacgaggaggatcgggacgatttggaggaggcaggcgagtacgaggacgaagcctgaccgggcaggtgttgttttagatgcagcggccggcggacggggccaccgcggatcccgcaattttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtaccgtcgcgcaccaacccgacgcacgagaaagtcctgactatcgtaaacgccctggtagacagcaaggctatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggttctctggtggcactgaacgcctttctgagcacgcagccggccaacgtgccccgcgggcaggaggattacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaatttgcaaggcatgtggggcgtcaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgtgtccgacagcattttcacgccggctaatcgccgattccagaagaaggagggcggagacgagctccccctctccagcgtggaagcggcctcaaggggagagagtccctttcccagtctgtcttctgccagtagcggtcgggtaacgcgcccgcggttgccgggggagagcgactacctgaacgaccccttgctgcgaccggctagaaagaaaaatttccccaacaacggggtggaaagcttggtggataaaatgaatcgttggaagacctacgcccaggagcagagggagtgggaggacagtcagccgcgaccgctggttccgccgcactggcgtcgccagagagaagacccggacgactccgcagacgatagtagcgtgttggacctgggagggagcggagccaacccctttgctcacttgcaacccaaagggcgttcgagtcgcctgtactaataaaaaagacgcggaaacttaccagagccatggccacagcgtgtgtcctttcttcctctctttcctcctcggcgcggcagaatgagaagagcggtgagagtcacgccggcggcgtatgagggcccgcccccttcttacgaaagcgtgatgggatcagcgaacgtaccggccacgctggaggcgccttacgttcctcccagatacctgggacctaccgagggcagaaacagcatccgttactccgagctcgcgcccctgtacgataccaccaaggtgtacctggtggacaacaagtcggcggacatcgcctccctgaattaccaaaacgaccacagcaacttcctgactaccgtggtgcagaacaatgacttcaccccgacggaggcgggcacgcagaccattaattttgacgagcgttcccgctggggcggtcagctgaaaaccatcctgcacaccaacatgcccaacatcaacgagttcatgtccaccaacaagttcagggctaagctgatggtagaaaaaattagcggacaacctcccaaatatgaatggttcgagttcaccattcccgagggtaactactccgagaccatgactatcgatctgatgaataacgcgattgtggacaattacctgcaagtggggaggcagaacggggtattggaaagcgatatcggtgtgaaatttgataccagaaacttccgactggggtgggatcccgtgaccaagctggtgatgccaggcgtgtacaccaatgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcggcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaagaggcgctccagtcagcacccagttcgagttcggggccacttccgcgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggagagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgtcacgtcagcttcaaccgccgtggaagccatggaaacgcaaaccgaaacccccgccgcggttggtacgaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacaattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgcgggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgcggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggtacaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaacgcagttgtggacttgcaagacagaaacaccgaattgtcataccagcttatgctcgacgcattgggagacagaagtcgatacttttcaatgtggaatcaagctgtcgacagttacgatccagatgttaggataattgaaaaccacggcgttgaagacgagcttccaaattattgttttccactaaatggacagggaatttcaaacacctacaaggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggccggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctccgcaacgacaccaacgaccagtccttcaacgactacctgtgcgcagctaacatgctgtaccccatccccgcgaacgccaccagcgtgcccatctctattccctctcgcaactgggcagcctttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggccaggcaacgaccgcctgctaacgcccaacgagttcgaaattaagcgttcggtagacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctaatcggggccaccgccgtacccagcctgacgcagaaaaagttcctctgtgaccgggtgatgtggaggatccccttctctagcaactttatgtctatgggctccctcaccgacctggggcagaacatgctgtacgccaactccgctcacgccttggacatgacatttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtctcccccaccctgcgccgtaaccaggaacacctgtatcgctttttggggaaacactctgcctactttcgccgccaccggcagcgcattgaacaggccacggcctttgaaagcatgaaccaaagagtgtaatcaataaaaaccatttttattttaacatgacacgcgcttctggcgttttttattaaaaatcgaagggttcgagggaggtgtcttcgtgcccgctggggagggacacgttgcggtactggaaacgggcgctccaacgaaactcggggatcaccagtcgcggcaggggcacgtcttccaggttctgcttccagaactgccgcaccagctgcagagctcccatcacgtcgggcgccgagatcttgaagtcgcagttagggccggagctcccgcggctgttgcggaacacggggttggcgcactggaacaccagcacgctggggttgtagatactagccagggccgtcgggtcggtcacctccgacgcatccagatcttcggcgttgctcagggcgaacggggtcagcttgcacatctgccgcccgatctggggcaccaggtcggatttgttgaggcaatcgcagcgcagagggatgaggatgcgacgctgcccgcgttgcatgatagggtaactcgctgccaggaactcctccatctgacggaaggccatctgggccttcgtgccctcggtgaaaaagagcccacaggacttgctagagaatacgttattgccgcagttgatgtcttccgagcagcagcgggcgtcttcattcttcagctgaaccacgttgcgaccccagcggttctggaccaccttggctttcgtaggatgctccttcaacgcccgctgaccgttctcgctggtcacatccatttccaccacgtgctccttgcagaccatctccactccgtggaagcagaacaggacgccctcctgccgggtattgcgatgctcccacacagcgcacccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccaaggtgccttcgccctcgctgtcggaaacgatctccggggagggcggcggcgcgggtgttgccttgcgagccttcttcttgggagggagcggaggcacctcctgctcgcgctcggggctcatctcccgcaagtagggggtgatggagcttcctgcttggttctgacggttggccattgtatcctaggcagaaagacatggagcttatgcgcgaggaaactttaaccgccccgtcccccgtcagcgacgaagatgtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatagttaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcgactcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcaaacgctctgcagaaagaacagaaagaaagtcagaacgtgctggtggagctggaaggggacaacgcgcgtctggccgtcctcaaacgttgcgtagaagtttcccacttcgcctaccccgccctcaacctgccgcccaaagttatgaaatcggtcatggaccagctactcatcaagagagctgagcccctggatcccgaccaccctgaggcggaaaactcagaggacggaaagcccgttgtcagcgacgaggagctcgagcggtggctggaaaccagggatccccagcagttgcaagagaggcgcaagatgatgatggcggccgtgctggtcacggtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggcgtgtggcagcagtgcttggaagagagaaacctcaaagagctggacaaactcctctgccgccagcggcgggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctcttttgtcctggagcgctccgggatcttgcccgccatgagctgcgcgctgccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaaaatcctggcccaattgcaatccatcaaccaagcgcgccgagatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttctccctcgggcgccaaaacccacgtcatcgccagcatgagcaaggagattcccaccccttacatgtggagctatcaaccccagatgggcctggccgcgggggccgcccaggactactccagcaaaatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcggccgcaaacccactccttcttcaaaataacacactgagtcttatttccagtgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacataaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatctatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggcgccctgcttaacatgactcaaacctctgtaacaatccagttcacatttgataatactggttcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccaattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggtaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttgacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaagggaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaataaagaacaactttttttaaatttcatttttattttacacgcacggtaaggcttcctccacccttccatttgacagcatacaccagagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatcgtaaaccagggaccgacgcacctcctcgtacttgtggtagcagaaccacgtccgccgccaacaggtctccacgtaacgccggtccctgcgtcgctcgcgctctctcctcagtgcaaagtgcaaccactcttgtaatccacacagatccctctcggcctccggggtgatgcacacctcaaaccgacagatgtctcggtacagttccaaacacgtagtgagggcgagttccaaccaagacagacagcctgatctatcccgacacactggaggtggaggaagacacggaagaggcatgttattccaagcgattcagcagtgggtcgaaatgaagatcccgaagatgacaacggtcgcctccggaaccctggtggaatttaacagccagatcaaacattatacgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgttaggaactaaatcaggtgtggctacgcagcacaaaagttccagggatggtgccaaactcgctaaaaccgctcccgagtagcaaaactgatgaatgggagtaacacagtgtaaaatgttcagccaaaaatcactaagctgctcctttaaaaagtccagtacttctatattcagtccgtgcaagtactgaagcaactgtgcgggaatatgcacaacaaaaaaaatagggcggctcagatacatgttgacctaaaataaaaataaacattaaactaaagaagcttggcgaacggtgggatatatgacacgctccagcagcaggcaagcaaccggctgtccccgggaaccgcggtaaaattcatccgaatgattaaaaagaacaacagagacttcccaccatgtactcggttggatctcctgagcacagagcaatacccccctcacattcatatccgccacagaaaaaaagcgtcccaaatacccagcgggaatatccaacgacagctgcaaagacagcaaaacaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtaaacagccacaaaaaatcgagctaaaatccacccaacagcctatagctatatatacactccgcccaatgacgctaataccgcaccacccaccaccaaagttcacccacacccacaaaacccgcgaaaatccagcgccgtcagcacttccgcaatttcagtctcacaacgtcacttccgcgcgccttttcccattcccacacacacaaacgccgccctcgcgccaccccgcgtcaccctcgcgtcaccccggccccgcctcgctcattatcatattggcacgtttccaaaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 261 - DNA, 38534 bp, Artificial Sequence
  Synthetic oligonucleotide pWe/RhAd66.pIX-rITR.dE3.5E4
gccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctacgtaccgactatgaatccagcgatgaggagtgaggtgaggggcggagccacaaagggtataaaggggcatgaggggtgggcgcggtgtttcaaaatgagcggaacgacggacggcaacgcgtttgaggggggagtgttcagtccatatctgacatctcgtcttccttcctgggcaggagttcgtcagaatgtagtgggctccaccgtggacggacgaccggtggcccctgcaaattccgccaccctcacctatgccaccgtgggatcatcgttggacactgccgcggcagctgccgcttctgctgccgcttctactgctcgcggcatggcggctgattttggactgtataaccaactggccactgcagctgtggcgtctcggtctctggttcaagaagatgccctgaatgtggtgctgcttcggctggaggatctgtctcgacgcttggatcaactagctgcgcagatatccccatctaaccccgattctacagaatcttaaataaagacaaacaaatttgttgaaaataaacggctttatttgttttttttggctcggtaggctcgggtccacctgtctcggtcgttaaggactttgtgtatgttttccaaaacacggtacagatgggcttggatgttcaagtacatgggcatgagaccatctttggggtggagataggaccactgaagagcgtcatgctccggggtggtgttgtaaatcacccagtcgtagcagggtttctgggcgtggaactggaagatgtccttcaggagcaggctaatggccaggggtagacccttagtgtaggtgtttacaaagcggttgagctgggagggatgcatgcggggggagatgatatgcatcttggcttggattttaaggttagctatgttaccacccaggtccctgcgggggttcatgttatgaaggaccaccagcacggtgtagccggtgcatttggggaacttgtcatgcagtttggaggggaaggcgtggaagaatttagagacccccttgtgtccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtccacctggggggcgataaagaacacggtttctggcgggggattgatgagctgggtggaaagcaagttacgcaacagttgggatttgccgcaaccggtggggccgtagatgaccccgatgacgggctgcagctggtagttgagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttggcgggatcaaaaaccaagttgccaccattttttttgatgcgtttcttaccttgcgtctccatgagtttgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcaccccccaaaggggtataaaagggggcgtgcccaccctccccgtcactttcttccgcatcgctgtggaccagagccagctgttcgggtgagtaggccctctcaaaagccggcatgatttcggcgctcaagttgtcagtttctacaaacgaggtggatttgatattcacgtgccccgcagcgatgcttttgatggtggaggggtccatctgatcagaaaacacgatctttttattgtcaagtttggtggcgaaagacccgtagagggcgttggaaagcaacttggcgatggagcgcagggtctgatttttttcccgatcggccctctccttggcggcgatgttgagttgcacgtactcgcgagccacgcaccgccactcggggaacacggcggtgcgctcgtcgggcaggatgcgcacgtgccagccgcggttgtgcagggtgatgaggtccacgctggtggccacctccccgcggaggggctcgttggtccaacacaatcgccccccttttctggagcagaacggaggcaggggatctagcaagttggcggacggggggtcggcgtcgatggtgaagatgccgggtagcagaattttattaaaataatcgatttcggtgtccgtgttttgcaacgcgtcttcccacttcttcaccgccagggccctttcgtagggattcaggggcggtccccagggcatggggtgggtcagggccgaggcgtacatgccgcagatgtcgtacacgtacaggggctccctcaacaccccgatgtaagtggggtaacagcgccccccgcggatgctggctcgcacgtagtcgtacatctcgtgagagggagccatgagcccgtctcccaagtgggtcttgcggggtttctcggcccggtagaggatctgcctgaagatggcgtgggagttggaagagatggtggggcgttggaaaacgttaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgcctgggattggggagggcgaaggtgacgtcgttaaagaggattttcccggcgcggggcatgaagttgcgagagatcctgaagggtccgggcacgtccgagcggttgttgatgacttgcgccgccaggacgatctcatcgaagccgttgatgttgtggcccacgatgtaaagttcgataaagcgcggctgtcccttgagggccggcgcttttttcaactcctcgtaggtgagacagtccggcgaggacagacccagctcagcccgggcccagtcggagagttgaggattagccgcgaggaaggaactccatagatccaaggccaggagagtttgcaagcggtcgcggaactcgcggaactttttgcccacggccattttctccggcgttaccacgtaaaaggtgtcggggcggttgttccagacgtcccatcggagctctagggccagctcgcaggcttggcgaacgagggtctcctcgcccgagacgtgcatgaccagcatgaagggtaccaactgtttcccaaacgagcccatccatgtgtaggtttctacgtcgtaggtgacaaagagccgctgggcgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagactggggcttggtggggcggcatccccttcgccttggcggtgggagtctgcgtctgcgcccttcttctctgggtggacgacggtggggaagacgacgccccgggtgccgcaagtccagatctccgccacggaggggcgcaggcgctgcaggagggggcgcagctgcccgctgtccagggagtcgagggcggccgcgctgaggtcgacgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagaggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtcagcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgtcgcagggtcatctcgttgatgtctccgatggcttcgagacgctccatggcctcgtagaagtcgacggcgaagttgaaaaattgggagttgcgggcggctaccgtgagttcttcttgcaggaggcggatgagatcggcgaccgtgtcgcgtacctcctgttcgaaagcgccccgaggcgcctctacttcttcctccggctcctcctcttccaggggcacaggttcctccgccagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaaaacgccgccgcgcagagcgcccccgtgcagggagggtaagtggttagggccgtcgggcagggacacggcgctgacgatgcattttatcaattgctgcgtaggcactccgtacagggatctgagaacgtcgaggtcgacgggatccgagaacttctctaggaaagcgtctatccaatcgcaatcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgttcggccatgccccaggcctcgctctgacagcgacgcaggtctttgtagtagtcttgcatcagtctctccaccggaacctctgcttctcccctgtctgccatgcgagtcgagccgaacccccgcaggggctgcagcaacgctaggtcggccacgaccctttcggccagcacggcctgttgaatctgcgtgagggtggtctggaagtcgtccaggtccacgaagcggtgataggcccccgtgttgatggtgtaggtgcagttggccatgacggaccagttgacgacttgcataccgggttgggtgatctccgtgtacttgaggcgcgagtaggccctggactcgaacacgtagtcgttgcatgtgcgcaccagatactggtagccgaccaggaagtgaggaggcggctctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcaggggacggaagcgttccatggtgggcacgctctgccccgtgaggcgggcgcagtcctgtacgctctagatggaaaaaagacagggcggtcatcgactcccttccgtagctcggggggtaaagtcgcaagggtgcggcggcggggaaccccggttcgaaaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgaccccagacgcccaccaccaccgccgcggcggcagtaaacctgagcggaggcggtgacagggaggaggaggagctggctttagacctggaagagggagaggggctggcccgactgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggtagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacctctgacggcccagctgttcctgatcgtgcagcacagccgcgacaacgaaacgttccgcgacgccatgttgaacatcgcggagcccgagggtcgctggctcttggatctgattaacatcttgcagagcatcgtggtgcaggagagggggctgagtttagcggacaaggtggcggccattaactattcgatgcagagcctggggaagttctacgctcgcaagatctacaagagcccttacgtgcccatagacaaggaggtgaagatagacagcttttacatgcgcatggcgctgaaagtgctgacgctgagcgacgacctcggcgtgtaccgtaacgacaagatccacaaggcggtgagcgccagccgccggcgggagctgagcgacagagagctgatgcacagcctgcagagggcgctggcgggcgccggggacgaggagcgcgaggcttacttcgacatgggagccgatctgcagtggcgtcccagcgcgcgcgccttgaaggcggcgggctaccccgacgaggaggatcgggacgatttggaggaggcaggcgagtacgaggacgaagcctgaccgggcaggtgttgttttagatgcagcggccggcggacggggccaccgcggatcccgcaattttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtaccgtcgcgcaccaacccgacgcacgagaaagtcctgactatcgtaaacgccctggtagacagcaaggctatccgccgcgacgaggcgggcttgatttacaacgctctgctggaacgggtggcgcgctacaacagcactaacgttcagaccaatctggatcgcctcaccaccgacgtgaaggaggcgctggctcagaaggagcggtttctgagggacagcaatctgggttctctggtggcactgaacgcctttctgagcacgcagccggccaacgtgccccgcgggcaggaggattacgtgagcttcatcagcgctctgaggctgctggtgtccgaggtgccccagagcgaggtgtaccagtctgggccggattacttcttccagacgtcccgacagggcttgcaaacggtgaacctgactcaggcctttaaaaatttgcaaggcatgtggggcgtcaaggccccggtgggcgatcgcgccactatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagccgggccctgggtcaggaagataccggcagcctggaagccacgttgaactttttgctaaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgtgtccgacagcattttcacgccggctaatcgccgattccagaagaaggagggcggagacgagctccccctctccagcgtggaagcggcctcaaggggagagagtccctttcccagtctgtcttctgccagtagcggtcgggtaacgcgcccgcggttgccgggggagagcgactacctgaacgaccccttgctgcgaccggctagaaagaaaaatttccccaacaacggggtggaaagcttggtggataaaatgaatcgttggaagacctacgcccaggagcagagggagtgggaggacagtcagccgcgaccgctggttccgccgcactggcgtcgccagagagaagacccggacgactccgcagacgatagtagcgtgttggacctgggagggagcggagccaacccctttgctcacttgcaacccaaagggcgttcgagtcgcctgtactaataaaaaagacgcggaaacttaccagagccatggccacagcgtgtgtcctttcttcctctctttcctcctcggcgcggcagaatgagaagagcggtgagagtcacgccggcggcgtatgagggcccgcccccttcttacgaaagcgtgatgggatcagcgaacgtaccggccacgctggaggcgccttacgttcctcccagatacctgggacctaccgagggcagaaacagcatccgttactccgagctcgcgcccctgtacgataccaccaaggtgtacctggtggacaacaagtcggcggacatcgcctccctgaattaccaaaacgaccacagcaacttcctgactaccgtggtgcagaacaatgacttcaccccgacggaggcgggcacgcagaccattaattttgacgagcgttcccgctggggcggtcagctgaaaaccatcctgcacaccaacatgcccaacatcaacgagttcatgtccaccaacaagttcagggctaagctgatggtagaaaaaattagcggacaacctcccaaatatgaatggttcgagttcaccattcccgagggtaactactccgagaccatgactatcgatctgatgaataacgcgattgtggacaattacctgcaagtggggaggcagaacggggtattggaaagcgatatcggtgtgaaatttgataccagaaacttccgactggggtgggatcccgtgaccaagctggtgatgccaggcgtgtacaccaatgaggcttttcaccccgacatcgtgctgctgccggggtgcggcgtggatttcactcagagccgcttgagtaacctgttaggaatcaggaagcgccgtcccttccaggagggctttcagatcatgtatgaggacctggagggaggcaacattccagggctgttagacgttcctgcttatgaggacagcgtgaaaaaggcggaagcccaaggacgggagattcggggcgacacctttgccacggaacctcatgcgctggtcataaaacccttgaccgaagatagtaaaaaacgaagttataacattattaccggcactatggacaccgaatatcggagctggtttctggcttacaactacggggatcccgaaaagggagtgagatcatggaccatactcaccaccacggacgtgacctgcggctcgcagcaagtgtactggtccctgccggatatgatgcaagacccggtcaccttccgcccctccacccaggtcggcaactttccggtggtgggcaccgagctgctgcccgtccatgccaagagcttctacaacgagcaggccgtttactcgcaactcattcgccagtccaccgcgcttacccacgtgttcaatcgctttcccgagaaccagattctggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgtccctacgtttacaaagctcttggcgtagtggctcccaaagttctctctagtcgcaccttctaaacatgtccatcctcatctctcccgataacaacaccggctggggactgggctccggcaagatgtacggcggagccaagaggcgctccagtcagcacccagttcgagttcggggccacttccgcgctccctggggagcttacaagcgaggactctctggccgaacggctgtagacgataccatagatgccgtgattgccgacgcccgccggtacaaccccggaccggtcgctagcgccgcctccaccgtggattccgtgatcgacagcgtggtagccggcgctcgggcctatgctcgccgcaagaggcggctgcatcggagacgtcgccccaccgccgccatgctggcagccagggccgtgctgaggcgggcccggagggtaggcaggagggctatgcgccgcgctgccgccaacgccgccgccggcagggcccgccgtcaggctgcccgccaggccgccgctgccatcgctagcatggccagacccaggagagggaacgtgtactgggtgcgcgattctgtaacgggagtccgagtgccggtgcgcagccgacctccccgaagttagaagatccaagctgcgaagacggcggtactgagtctccctgttgttattagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagttttgccccgcggcgcagggttcaatggaaagggcgacgggtacaacgcgttttgaggccgggcaccgcggtagtttttaccccgggagagcggtcggccgttaggggtttcaaaaggcagtacgacgaggtgtacggcgacgaggacatattggaacaggcggctcaacagattggagaattcgcctatggaaagcgctcgcgtcgcggagacttggccatcgctttagacagcggcaatcccacacccagcctcaaacccgtgacactgcaacaagtgctccccgtgagcgccagcacggagagcaagaggggaataaaaagagaaatggaagatctgcagcctaccatccagctcatggttcctaaacggcagaggctggaagaggtcctggagaagatgaaagtggaccccagcatagagccggacgtcaaagtcaggccgatcaaagaagtggcccctggactcggggtgcagacggtggatatccagatccccgtcacgtcagcttcaaccgccgtggaagccatggaaacgcaaaccgaaacccccgccgcggttggtacgaaagaagtggcgttgcaaaccgacccctggtacgaatttgccgccccccggcgtcagaggcgacccgctcgttacggccccgccaatgccatcatgccagaatatgcgctgcatccgtctatcctgcccacccccggctaccggggagtgacgtatcgcccgtcgggaacccgccgccgaacccgtcgccgccgccgctcccgtcgcgctctggcccccgtgtcggtgcgccgcgtgacccgccggggaaagacagtcaccattcccaacccgcgctaccaccctagcatcctttaatgactctgccgttttgcagatggctctgacttgccgcgtgcgccttcccgttccgcactatcgaggaagatctcgtcgtaggagaggcatggcgggcagtggtcgccggcgggctttgcgcaggcgcatgaaaggcggaattttacccgctctgatacccataatcgccgccgccatcggtgccatacccggcgttgcttcagtggccttgcaagcagctcgtaataaataaacgaaggctttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacaattaaatcctacggcagcaaagcctggaacagtagtgctggtcagatgctccgagataagctgaaggataccaacttccaagaaaaagtggtcaacggggtggtgaccggcatccacggcgcggtagatctcgccaaccaagcggtgcagaaagagattgacaggcgtttggaaaactcgcgggtgccgccgcagaggggggatgaggtggaggtcgaggaagtagaagtagaggaaaagctgccccccttggagaaagttcccggtgggattccaaggccgcagaagcggcccaggccagaactagaagagactctggtgacggaaagcaaggaacctccctcgtacgagcaagctttaaaagatggcgccactccaccctacccaatgacaaaaccgatcgcgcctatggctcggccggtgtacgggaaggactacaagcctgtcacgctagagctccccccgccgccaccgccgccccccacgcgcccgaccgttccttccctgccggctccgtcggcggccgcggcgggacccgtgtccgcacccgttgtcgtgcctctgccagccgcccgcccagtggccgcggccactgccagaaaccccagaggccagagaggagccaactggcaaagcacgctgaacagcatcgtgggcctgggagtgaaaagcctgaaacgccgccgttgctattattaaaagtgtagctaaaaaatttcccgttgtatacgcctcctatgttaccgccagagacgcgtgactgtcgccgcgagcgccgctttcaagatggccaccccatcgatgatgccgcagtggtcttacatgcacatcgccgggcaggacgcctcggagtacctgagtcccggcctcgtgcagtttgcccgcgccaccgacacctacttcagcttgggaaacaagtttagaaaccctaccgtggctcccacccacgatgtgaccacggaccgctcgcagaggctgaccctgcgttttgtgcccgtagaccgggaagacaccgcgtactcttacaaagtgcgcttcaccctggctgtaggagacaacagagtgttggacatggccagcacgtatttcgacattcgcggaatgttagatcgcggtcccagctttaaaccctattctggcaccgcttacaactctttagctcctaaaggcgctccaaacccgagtcagtggataacgaacgggggaacagcaaaaaccaattcttttgctcaagcgtcgtacataggtatgggggcaaacctaacaacaaacggcatccaagtggcagtagacacaaacaatgccaacgccgcggtgtacgcgaataagatttaccagccagagcctcaagttggaacatcacaatggaacattaatcccacgcaaaatgccgcgggaagaattctaaaaccaacaaccccaatgcaaccttgctacggttcctacgcttaccctactaatgaaaacggcggtcaagtaaaaattaccgatggtacaacggaccccactggcgcaaacagcgtcagcatggagtttttcacaaccaccgccgataaccagaatcaagctaaggttgtactgtacagcgaagacgttaatttggaagcgcctgacacccacttggtttttaaacccgacgttgcagataatgcaaaagctgcagaaacccttctagggcagcagtccgctcccaacagacccaattacattggattcagagataactttatcggtctaatgtattacaactcaactggaaatatgggagtgttggcaggtcaagcgtctcagttaaacgcagttgtggacttgcaagacagaaacaccgaattgtcataccagcttatgctcgacgcattgggagacagaagtcgatacttttcaatgtggaatcaagctgtcgacagttacgatccagatgttaggataattgaaaaccacggcgttgaagacgagcttccaaattattgttttccactaaatggacagggaatttcaaacacctacaaggggctgtctgtacaaaatggacaaaacacatggcaggctaacaacaacgctgccgaaaacaatgaaatttccatcggcaacatttttgcgatggaaataaatttggcagctaatttgtggcgcagttttctatactccaatgttgccctgtacttgccagactcctacaagtacacccctgacaacattgaacttccaacaaaccaaaacagctacggctacattaacggcagggttactgcccccaacgctattgatacatatgtcaatattggcgcccgttggtctcccgatcccatggacaacgttaacccttttaatcaccaccgcaacgccggtctgcgctatcgctctatgctcctaggtaacggccggtacgtacccttccacattcaggtgccccagaaattttttgctattaagaatctgcttttactgcctgggtcttacacctacgaatggaacttcagaaaagatgtgaacatgatcttgcagagcactctgggcaacgacctgcgtgtcgacggggctagcgttagattcgacagcattaacctctacgcaaattttttccccatggcccacaacacggcttccaccctggaggccatgctccgcaacgacaccaacgaccagtccttcaacgactacctgtgcgcagctaacatgctgtaccccatccccgcgaacgccaccagcgtgcccatctctattccctctcgcaactgggcagcctttaggggctggagttttacccgccttaaaaccaaggaaactccctcgctgggctccggttttgacccatactttgtctactccggctccattccctacctggacggcaccttttacctcaaccacacttttaaaaaggtgtccatcatgtttgactcatcggtcagctggccaggcaacgaccgcctgctaacgcccaacgagttcgaaattaagcgttcggtagacggtgaagggtacaacgtggcccaaagcaacatgaccaaggactggttcctgattcagatgctcagccactacaacatcggctaccagggcttctacgtgcccgaaaactacaaggaccgcatgtactccttcttcagaaacttccaacctatgagtcggcaggtggtagactcggttaactatgctaactacaaggaagtaaaaatgccattccagcacaataactccggctttgtggggtacatgggtcccaccatgcgagaggggcaggcctacccggccaattatccctatcccctaatcggggccaccgccgtacccagcctgacgcagaaaaagttcctctgtgaccgggtgatgtggaggatccccttctctagcaactttatgtctatgggctccctcaccgacctggggcagaacatgctgtacgccaactccgctcacgccttggacatgacatttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagccaatgggctccagcgaacaggagctgcaggccattgttcgcgacctgggctgcgggccctactttttgggcaccttcgacaagcggttccccggcttcatgtccccccacaagccggcctgtgccatcgttaacacggccggacgggaaaccgggggggtccactggctcgccttcgcctggaacccgcgtaaccgcacctgctacctgttcgacccttttggtttctccgacgaaaggctgaagcagatctaccagttcgagtacgaggggctcctcaagcgcagcgctctggcctccacgcccgaccactgcatcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtctcccccaccctgcgccgtaaccaggaacacctgtatcgctttttggggaaacactctgcctactttcgccgccaccggcagcgcattgaacaggccacggcctttgaaagcatgaaccaaagagtgtaatcaataaaaaccatttttattttaacatgacacgcgcttctggcgttttttattaaaaatcgaagggttcgagggaggtgtcttcgtgcccgctggggagggacacgttgcggtactggaaacgggcgctccaacgaaactcggggatcaccagtcgcggcaggggcacgtcttccaggttctgcttccagaactgccgcaccagctgcagagctcccatcacgtcgggcgccgagatcttgaagtcgcagttagggccggagctcccgcggctgttgcggaacacggggttggcgcactggaacaccagcacgctggggttgtagatactagccagggccgtcgggtcggtcacctccgacgcatccagatcttcggcgttgctcagggcgaacggggtcagcttgcacatctgccgcccgatctggggcaccaggtcggatttgttgaggcaatcgcagcgcagagggatgaggatgcgacgctgcccgcgttgcatgatagggtaactcgctgccaggaactcctccatctgacggaaggccatctgggccttcgtgccctcggtgaaaaagagcccacaggacttgctagagaatacgttattgccgcagttgatgtcttccgagcagcagcgggcgtcttcattcttcagctgaaccacgttgcgaccccagcggttctggaccaccttggctttcgtaggatgctccttcaacgcccgctgaccgttctcgctggtcacatccatttccaccacgtgctccttgcagaccatctccactccgtggaagcagaacaggacgccctcctgccgggtattgcgatgctcccacacagcgcacccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggctccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccaaggtgccttcgccctcgctgtcggaaacgatctccggggagggcggcggcgcgggtgttgccttgcgagccttcttcttgggagggagcggaggcacctcctgctcgcgctcggggctcatctcccgcaagtagggggtgatggagcttcctgcttggttctgacggttggccattgtatcctaggcagaaagacatggagcttatgcgcgaggaaactttaaccgccccgtcccccgtcagcgacgaagatgtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatagttaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcgactcaacttctaccccgtgttcgccgtaccagaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcaaacgctctgcagaaagaacagaaagaaagtcagaacgtgctggtggagctggaaggggacaacgcgcgtctggccgtcctcaaacgttgcgtagaagtttcccacttcgcctaccccgccctcaacctgccgcccaaagttatgaaatcggtcatggaccagctactcatcaagagagctgagcccctggatcccgaccaccctgaggcggaaaactcagaggacggaaagcccgttgtcagcgacgaggagctcgagcggtggctggaaaccagggatccccagcagttgcaagagaggcgcaagatgatgatggcggccgtgctggtcacggtggagctagaatgcctgcaacggtttttcagcgacgtggagacgctacgcaaaatcggggagtccctgcactacaccttccgccagggctacgttcgccaggcctgcaaaatctccaacgtagagctcagcaacctggtttcctacatgggcatcctccacgagaaccggctggggcagagcgtgctgcactgcaccttgcaaggcgaggcgcggagggactacgtccgagactgcgtctacctcttcctcaccctcacctggcagaccgccatgggcgtgtggcagcagtgcttggaagagagaaacctcaaagagctggacaaactcctctgccgccagcggcgggccctctggaccggtttcagcgagcgcacggtcgcctgcgccctggcagacatcattttcccggaacgcctgatgaaaaccttgcagaacggcctgccggatttcatcagtcagagcatcttgcaaaacttccgctcttttgtcctggagcgctccgggatcttgcccgccatgagctgcgcgctgccttctgactttgtccccctttcctaccgcgagtgccctcccccactgtggagccactgctacctcttccaactggccaactttctggcctaccactccgacctcatggaagacgtgagcggagaggggctgctcgagtgccactgccgctgcaacctctgcaccccccacagatcgctggcctgcaacaccgagctgctcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaaaatcctggcccaattgcaatccatcaaccaagcgcgccgagatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcagcagcaggtggaggacgaggaagagctgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcaacggcagcgggtaaggccaaacgcgagcggcgggggtattgctcctggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctccgccgcgaggaaaaactccgccgccgctgccgccgccaaggatccaccggccaccgaggagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttctccctcgggcgccaaaacccacgtcatcgccagcatgagcaaggagattcccaccccttacatgtggagctatcaaccccagatgggcctggccgcgggggccgcccaggactactccagcaaaatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgaggcggtgagctcctcaaccggtctcagacctgacggagtcttccagctcggaggagcgggccgctcttccttcaccactcgccaggcctacctgaccctgcagagctcttcctcgcagccgcgctccgggggaatcggcactctccagttcgtggaagagttcgtcccctccgtctacttcaacccgttctccggctcacctggacgctacccagacgccttcattcccaactttgacgcagtgagtgaatccgtggacggctacgactgatgacagatggtgcggccgtgagagctcggctgcgacatctgcatcactgccgtcagcctcgctgctacgctcgggaggcgtttgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttctgccacaccttcaacgtcgcgcgtcgttcctcctcagattgttaacagctcttcaattagaggtattcgagaaactgtttactttgacaactctactaatcttcttaccctcaactgctcttgtactaaccggacctgtcgagggggctatcctgtgccactgtcacgcgcctgattgcatgtccaaactaatcagaacgctctgcgctctaggtgatatttttaagatgtgaatcatcaataaacttaccttaaatttgacagcaactttttggtagcatcattcagcagcaccactttaccctcttcccaactctcataggggatgtgatggtgggtggcaaacttcctccaaattctaaaagagatattaatgtccacttccttacccttacccacaattttcatcttttcagagatgaaaagaaccagagttgatgaagacttcaacccagtatacccttatgacaccacttctactccagccatcccttttatatcacccccgtttgtaaacagcgatgggtttcaagaaagcccacccgggattttaagcttacgccttaacaaacctctgtcattcactaatcacgctgttagcttaaacgttggctcaggtttaaccattaactccactggcttcctagaagctactcagcagatttcggccgcaaacccactccttcttcaaaataacacactgagtcttatttccagtgcccccctgtacgttaatggatcggcgctcgcccttcgacttaactcaccttttgttgtacacaacaacgggcttgctataaatctagctgaaccattatacgttaccaacaactcgctaaatttgcgtttggcaagtccattctatgttaacaataactcactgaatttaagacttcccaacccctccggtttaagtattgatggttctggcttaaaagttaaagctggatatggtctacgtttgcatgctaacaatgacctatatgtttacactgatttcccattagacaaatatgataacggagccaaacaagggcagttatacttaaggacaggaaaaggattgcaattaagcaacaatgacctaacggtaaagctaggagcggggctaaagtttgacaacaatggagcaatcactctagcttccacttaattttccagatgaaacgcgctcgaattgatgaagactacaaccctgtatacccctataacacttctactccacccttcattgccccaccttttgtagacaacgatggctttcaggaaaaccctcagggagttttaagtttacgaatatccaaacccctgtactttgacataaacaaacgactaagcctttcccttggccaagggttatcaactacttccgctggggagttagaaagcgcacaaaatgtgcgagccaatccgccactatccataaacagcaacacagtttcccttcgctattcctccccattgaatcttaccgagaacggcttagttttaggctactcagatcctttacgcgtagtaggcggtgcgcttacatttaattacacatccccccttcgttatgaaaatgacagtttaacctttaactatacatcgccacttaaattaatgaataatagccttgccatcgaagtaaactcttctaaaggagttaccagtaaaaacggcgcaattgctgtgcagctgagtccagacttaaagtttgacagcaacggatctatagcttttgggatacaaactttgtggacatttcctaccacaacttctaactgcaccgtttttacaagcaatgactcccttcttagtctttgcttaactaagtgcggagctcatgtgttaggcagtgtaagtttaaccggaatggcaggcgccctgcttaacatgactcaaacctctgtaacaatccagttcacatttgataatactggttcgctaacatcgtccccacttattaacaacgcctggggaattcgccagaacgatagtgcatcgcccaaccccaccttcaatgctctgacatttatgccaaacagcactgtgtattcaagaggaggaagcggtgaacctcgcaacaattactacactcagacctacctcaggggtaatatccgaaaaccaattgtcctaacggttacctacaactctgccaatacaggatattccttatcgtttaaatgggatgctattgcaaccgaaaaatttgccactcctacatcttcattttgctacatttcagaacaataaaatcctgttacacgccgtctcgtttttttcagatgaaacgtgcgagagttgatgaagacttcaacccagtgtacccttatgactccccaaatgctcccattatgccatttattactccgccgtttacatcttcggatgggttacaagagaaaccccttggagttcttagcttaaactacaaagatcccgttactacgcaaaacggatctcttactctaaaattaggaagcggccttaacattaacgatcaaggacagctcacatccactgctggagaggtggagcctccgctcactaacaacaacaacaaacttgcactagcctatagccaacctttagcagtagaaaacaaccgcctaatcgtatcttacaacgctcctcttgccgttactggtaattctttagggttgcaagtgtcagagcccatttttataaatgacaatgacaaactagctctgcaaacagccgccccacttaaaactaacgctggcacccttcgcttacaaagtgctgctccgttaggactagccgaagaaacccttaaactgctgttctccaaacctctatatttacaaggcgactttctttcactaggaattgaacgccccctggctatagcagccgcaggtactctggcactgcaactcactcctccattaacaaccaatgatagcggtttaacaatctccacagctgacccagtaactgtaagcaatggaaacctaggcttacgaatatcacgtcctctcgttgttcaaaacaatagcctttcgcttgccttgacccccccactacggctttttaacagcgaaccggtactcggtttgggctttaccttccctattaccgtagtggacaatctcctttccttaaacataggcaacgggcttacacttttatataataaactgacagctaatttgggtagagatttacagttccaaaacggagccatagctgtatccctgaccactgaaccacctttacaatatacaactaagcttcagcttaatgttggggccggtttacgttataacggcgcaagcagaaaactggacgttgatattaaccagcaaaagggcctcacctgggaaaataacgctgtagtgccaaaactgggacaggggctatactttgacccacaaggaaacattgccatgtcccccacaaacgtaaaaccggacactttatggacaacagccgacccctcaccaaattgctctgtgtacactgatttagatgcaaagctgtggctctctttagtgaagtgcggtgggatggtacaggggtcaattgctctacaagcccaaaagggtactttaatgagtgtgactgatccctcagttactattattttacactttaatgacaatggcgtacgtattaactatccaactttggataatcaagggaccctaggaagagactctacctggggatatagacaaggtcaatcagccaacactaatgttactaacgctgtagagttcatgcccaactcaagtagatatcctagagggagaggagaacaagcgcaaaaccaaactgttggttacacttgtttgcaaggtaatctttctatgccaatttttttccaagtccagtacaattatgtaaccactggatattccttcaaatttacttggcaagctgtacaaaggcaaaagtttgatattccttgctgttcattttcatacatcacagaagaataaagaacaactttttttaaatttcatttttatcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccattgccccgtcttaccgcgtaaacagccacaaaaaatcgagctaaaatccacccaacagcctatagctatatatacactccgcccaatgacgctaataccgcaccacccaccaccaaagttcacccacacccacaaaacccgcgaaaatccagcgccgtcagcacttccgcaatttcagtctcacaacgtcacttccgcgcgccttttcccattcccacacacacaaacgccgccctcgcgccaccccgcgtcaccctcgcgtcaccccggccccgcctcgctcattatcatattggcacgtttccaaaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 262 - DNA, 6068 bp, Artificial Sequence
  Synthetic oligonucleotide RhAdApt67.Empty
catcatcaataatataccttattctggaaacgtgccaatatgataatgagcggggaggagcgaggcggggccggggtgacgtgggaatggggagaggggcggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcccctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctagatcccatgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggtcgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcttaattaattcgaacccataatacccataatagctgtttgccatcgacgcgaggctggatggccttccccattatgattcttctcgcttccggcggcatcgggatgcccgcgttgcaggccatgctgtccaggcaggtagatgacgaccatcagggacagcttcaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgatggcaaacagctattatgggtattatgggttcgaattaattaa

SEQ ID NO: 263 - DNA, 38319 bp, Artificial Sequence
  Synthetic oligonucleotide pWe.RhAd67.pIX-rITR.dE3
catgtcaatggaactttttaaagtgataagatatgatgaaaccaagtctcgttgtcgctcatgtgaatgcggagctaatcatttgaggttgtatcctgtaaccctgaacgttaccgaggagctgaggacggaccaccacatgctgtcttgcctgcgtaccgactatgaatccagcgatgaggagtgaggtgaggggcggagctacaaagggtataaaggggcatgaggggtgggcgcggtgtttcaaaatgagcgggacgacggacggcaacgcgtttgaggggggagtgttcagtccatttctgacatctcgtcttccttcctgggcaggagttcgtcagaatgtagtgggctccaccgtggacggacgaccggtcgcccctgcgaattccgccaccctcacctatgccaccgtgggatcatcgttggacactgccgcggcagctgccgcttctgctgccgcttctactgctcgcggcatggcggctgattttggactgtataaccaattggccactgcagctgtggcatctcggtctctggttcaagaagatgccctgaatgtggtgctgcttcggctggaggatctgtctcggcgcttggatcaactagctgcgcagatatccccatctaaccccgattctacagaatcttaaataaagacaaacaaatttgttgaaaataaacggctttatttgttttttttggctcggtaggctcgggtccacctgtcccggtcgttaaggaccttgtgtatgttttccaagacccggtacagatgggcttggatgttcaagtacatgggcatgaggccatcccgggggtggagataggaccattgcagagcgtcatgttccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggaaagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggtcgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggaggatttgatattcacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgtactcgcgggccacgcaccgccactcggggaacacggcggtgcgctcgtcgggcaggatgcgcacgcgccagccgcggttgtgcagggtgatgaggtccacgctggtggccacctccccgcggaggggctcgttggtccaacacaatcgccccccttttctggagcagaacggaggcaggggatctagcaagttggcgggcggggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccgggcagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcaccctgttcccacagcgtgaagtcggtgcgctttttctgtctgggattggggagggcgaaggtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgatgaagcgcggctgtcccttgagggccggcgcttttttcaactcctcgtaggtgagacagtccggcgaggagagacccagctccgcccgggcccagtcggagagctgagggttagccgcgaggaaagagctccataggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttggcgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagctggaggaatgggtgttgatgtggtgaaagtagaagtcccgccggcgcacagagcattcgtgctgatgtttgtaaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttctctgggtggacgacggtggggacgacgacgccccgggtgccgcaagtccagatctccgccacggaggggcgcaggcgctgcaggaggggacgcagctgcccgctgtccagggagtcgagggcggccgcgctgaggtcggcgggaagcgtttgcaagttcactttcagaagaccggtaagagcgtgagccaggtgcagatggtacttgatttccaggggggtgttggaagaggcgtccacggcgtagaggaggccgtgtccgcgcggggccaccaccgtgccccgaggaggttttatctcactcgtcgagggcgagcgccggggggtagaggcggctctgcgccggggggcagcggaggcagtggcacgttttcgtgaggattcggcagcggttgatgacgagcccggagactgctggcgtgggcgacgacgcggcggttgaggtcctggatgtgccgtctctgcgtgaagaccaccggcccccgggtcctgaacctgaaagagagttccacagaatcaatgtctgcatcgttaacggcggcctgcctgaggatctcctgtacgtcgcccgagttgtcttgataggcgatctcggccatgaactgctccacttcttcctcgcggaggtcgccgtggcccgctcgctccacggtggcggccaggtcgttggagatgcgacgcatgagttgagagaaggcgttgaggccgttctcgttccacacgcggctgtacaccacgtttccgaaggagtcgcgcgctcgcatgaccacctgggccacgttgagttccacgtggcgggcgaagacggcgtagtttctgaggcgctggaagaggtagttgagcgtggtggcgatgtgctcgcagacgaagaagtacatgatccagcgccgcagggtcatctcgttgatgtctccgatggcttcgagacgctccatggcctcgtagaagtcgacggcgaagttgaaaaattgggagttgcgggcggccaccgtgagttcttcttgcaggaggcggatgagatcggcgaccgtgtcgcgcacctcctgctcgaaagcgccccgaggcgcctctgcttcttcctccggctcctcctcttccaggggcacgggttcctccggcagctctgcgacggggacggggcggcgacgtcgtcgtctgaccggcaggcggtccacgaagcgctcgatcatttcgccgcgccggcgacgcatggtctcggtgacggcgcgtccgttttcgcgaggtcgcagttcgaagacgccgccgcgcagagcgcccccgtgcagggagggtaagtggttagggccgtcgggcagggacacggcgctgacgatgcattttatcaattgctgcgtaggcactccgtgcagggatctgagaacgtcgaggtcgacgggatccgagaacttctctaggaaagcgtctatccaatcgcagtcgcaaggtaagctgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttgaatctgcgtgagggtggtctggaagtcgtccaggtccacgaagcggtgataggcccccgtgttgatggtgtaggtgcagttggccataacggaccagttgacgacttgcatgccgggttgggtaatctccgtgtacttgaggcgcgagtaggcgcgggactcgaacacgtagtcgttgcatgtgcgtaccagatactggtagccgaccaggaagtggggaggcggttctcggtacaggggccagccgacggtggcgggggcgccgggggacaggtcgtccagcatgaggcgatggtagtggtagatgtagcgggagagccaggtgatgccggccgaggtggtcgcggccctggtgaattcgcggacgcggttccagatgttgcgcagggggcgaaagcgctccatggtgggcacgctctgccccgtgaggcgggcgcaatcttgtacgctctagatggaaaaaagacagggcggtcatcgactcccttccgtagctcggggggtaaagtcgcaagggtgcggcggcggggaaccccggttcgagaccggccggatccgccgctcccgatgcgcctggccccgcatccacgacgtccgcgccgagacccagccgcgacgctccgccccaatacggaggggagtcttttggtgttttttcgtagatgcatccggtgctgcggcagatgcgacctcagacgcccaccaccaccgccgcggcggcagtaaacctgagcggaggcggtgacagggaggaggaggagctggctttagacctggaagagggagaggggctggcccggctgggagcgccgtccccagagagacaccctagggttcagctcgtgagggacgccaggcaggcttttgtgccgaagcagaacctgtttagggaccgcagcggtcaggaggcggaggagatgcgcgattgcaggtttcgggcgggcagagagctgagggcgggcttcgatcgcgagcggctcctgagggcggaggatttcgagcccgacgagcgttctggggtgagcccggcccgcgctcacgtctcggcggccaacctggtgagcgcgtacgagcagacggtgaacgaggagcgcaacttccaaaagagctttaacaatcacgtgaggaccctgatcgcgagggaggaggtgaccatcgggctgatgcatctgtgggacttcgtggaggcctacgtgcagaacccggccagcaaacccctgacggcccagctgttcctgatcgtgcagcacagccgcgacaacgagacgttccgcgacgccatgttgaacatcgcggagcccgagggtcgctggctcttggacctgattaacatcctgcagagcatcgtggtgcaggagaggggcctgagcttagcggacaaggtggcggccattaactattcgatgcagagcctggggaagttctacgctcgcaagatctacaagagcccttacgtgcccatagacaaggaggtgaagatagacagcttttacatgcgcatggcgctgaaggtgctgacgctgagcgacgacctcggcgtgtaccgtaacgacaagatccacaaggcggtgagcgccagccgccggcgggagctgagcgacagggagctgatgcacagcctgcagagggcgctggcgggcgccggggacgaggagcgcgaggcttacttcgacatgggagccgatctgcagtggcgtcccagcgcgcgcgccttggaggctgcgggctaccccgacgaggaggatcgggacgatttggaggaggcaggcgagtacgaggacgaagcctgaccgggcaggtgttgttttagatgcagcggccggcggacggggccaccgcggatcccgcacttttggcatccatgcagagtcaaccttcgggcgtgaccgcctccgatgactgggcggcggccatggaccgcatcatggcgctgaccacccgcaaccccgaggcttttaggcagcaaccccaggccaaccgtttttcggccatcttggaagcggtggtgccctcccgcaccaaccccacacacgagaaagtcctgactatcgtaaacgccctggtagacagcaaagctatccgccgcgacgaggcggggctgatctacaacgctctgttggaacgggtggcgcgctacaacagcactaacgtgcagaccaatctggatcgcctcaccacggacgtgaaggaggcgctggctcagaaggagcgctttctgagggacagcaatctgggttctctggtggcactcaacgccttcctgagcacgcagccggccaacgtgccccgcgggcaggaggactacgtgagcttcattagcgctctgaggctgctggtgtccgaggtgccccagagcgaggtgtatcagtccggaccggattacttttttcagacgtcccgccagggcttgcaaacggtgaacctgactcaggcctttaaaaacttgcaaggtatgtggggcgtcaaggccccggtgggcgatcgcgccaccatctccagtctgctgacccccaacactcgcctgctgctgctcttgatcgcgccgttcaccaacagtagcactatcagccgtgactcgtacctgggtcatctcatcactctgtaccgcgaggccatcggccaggctcagatcgacgagcatacgtatcaggagatcactaacgtgagtcgggctctgggtcaggaagacaccggcagcttggaagccacgttgaactttttgctgaccaaccggaggcaaaaaataccctcccagttcacgttaagcgccgaggaggagaggattctgcgatacgtgcagcagtccgtgagcctgtacttgatgcgcgagggcgccaccgcttccacggctttagacatgacggctcggaacatggaaccgtccttctactccgcccaccgaccgttcattaaccgtctgatggactacttccatcgcgcggccgccatgaacggggagtattttaccaatgccatcctgaatccgcattggatgcccccgtccggcttctacaccggggagtttgacctgcccgaagccgacgacggctttctgtgggacgacgtgtccgacagcattttcacgccggggaatcgccgattccagaagaaggagggcggagacgagctccccctctccagcgtggaagcggcctcaaggggagagagtccctttcccagtctgtcttccgccagtagcggtcgggtcacgcgcccgcggttgccgggggaaagcgactacctgaacgaccccttgctgcgaccggctaggaagaaaaatttccccaacaacggggtggaaagcttagtggataaaatgaatcgttggaagacctacgcccaggagcagcgggagtgggaggacagccagccgcggccgttggtcccgccgcactggcgtcgccagagagaagacccggacgactccgcagacgatagtagcgtgttggacctgggagggagcggagccaacccctttgctcacttgcaacccaaggggcgttcgagtcgcctctactaataaaaaagacgcggaaacttaccagagccatggccacagcgtgtgtcctttcttcctctctttcctcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctaccgagggcagaaacagcatccgttactccgagctggcgcccctgtacgataccaccaaggtgtacctggtggacaacaagtcggcggacatcgcctccctgaattaccaaaacgatcacagcaactttctgaccaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaacccaacagccccgatacgagtggtttgagtttactattccagagggcaactactccgagaccatgactatcgatctaatgaataacgcgatcgtggacaattacctgcaagtggggaggcagaacggggtattggaaagcgatatcggtgtgaaatttgataccagaaacttccgactggggtgggatcccgtgaccaagctggtgatgccaggcgtgtacaccaacgaggcttttcaccccgacatcgtgctgcttccggggtgtggtgtggactttactcagagccgcttgagtaacctgttaggaatcaggaagcgccgtcccttccaggagggctttcaaatcatgtatgaggacctggagggaggtaacattccaggcttgctagacgtgccggcgtatgaacaaagcttacagcaagcccaagaggaggggcgagtaactcgcggagacacctttgctacggctccccatgagttggtgattcagcctttaacgaaagacagtaaaaacagaagttacaaccttatacccaactctacggatacactgtaccggagctggttcctggcttacaactacggcgatcccgagaagggagtgagatcatggaccatactcaccaccacggacgtgacctgcggctcgcagcaagtgtactggtccctgccggatatgatgcaagacccggtcacctttcgcccctccacccaagtcagcaacttcccggtggtgggcaccgagctgctgcccgtccatgccaagagcttctacaacgagcaggccgtctactcgcaactcattcgccagtccaccgcgcttacccacgtgttcaatcgctttcccgagaaccagattttggtgcgccctcccgctcctaccattaccaccgtcagtgaaaacgttcccgccctcacagatcacggaaccctgccgctgcgcagcagtatcagtggagttcagcgcgtgaccatcaccgacgccagacgtcgaacctgcccctacgtttacaaagctcttggcgtagtggctcctaaagtgctctctagtcgcaccttctaaacatgtccatcctcatctctcccgataacaacaccggctggggactgggctccggcaagatgtacggcggagccaaaaggcgctccagtcagcacccagttcgagttcggggccacttccgcgctccctggggagcttacaagcgaggactctcgggccgaacggcggtagacgataccatagatgccgtgattgccgacgcccgccggtacaatcccggaccggtcgctagcgccgcctccaccgtggattccgtgatcgacagcgtggtggccggcgctcgggcctatgctcgccgcaagaggcggctgcatcggagacgtcgccccaccgccgccatgctggcagccagagccgtgctgagacgggcccggagggtaggcaggagggctatgcgccgcgctgccgccaacgcctccgccgggagggcccgccgacaggctgcccgccaggctgctgccgccatcgctagcatggccagacccaggagagggaacgtgtactgggtgcgcgattctgtgacgggagtccgagtgccggtgcgcagccgacctccccgaagttagaagatccaagctgcgaagacggcggtactgagtctccctgttgttatcagcccaacatgagcaagcgcaagtttaaagaagaactgctgcagacgctggtgcctgagatctatggccctccggacgtgaagcctgacattaagccccgcgatatcaagcgtgttaaaaagcgggaaaagaaagaggaactcgcggtggtagacgatggcggagtggaatttattaggagtttcgccccgcggcgcagggtgcagtggaaagggcggcgggtacaacgcgttttgaggccgggcaccgcggtagtttttaccccaggacagcggtcggccgtcaggggtttcaaacggcagtacgacgaggtgtacggcgacgaggacatactggaacaggcggctcaacagatcggagaattcgcctacgggaagcgttctcgccgcgaagacttggccatcgccttagacagcggcaaccccactcccagtctcaaacccgtgacgctgcagcaggtgctccccgtgagcgccagcacggacagcaagaggggaataaaaagagaaatggaagatctgcagcccaccatccagctcatggtccctaaacggcagaggctggaagaggtcctggagaagatgaaagtggaccccagcatagagccggacgtcaaagtcaggccgattaaagaagtggcccctggactcggggtgcagacggtggacatccagatccccgtcacgtcagcttcgaccgccgtggaagccatggaaacgcaaacggaaacccctgtcgcgatcggtaccagagaagtgtcgttgcaaaccgacccctggtacgaatttgccgccccccggcgtcagaggcgacccgctcgttacggccccgccaacgccatcatgccagaatatgcgctgcatccgtctatcctgcccacccccggctaccggggagtgacgtatcgcccgtcaggaacccgccgccgaacccgtcgccgccgccgctcccgtcgcgctctggcccccgtgtcggtgcgccgcgtaacccgccggggaaagacagtagtcatccccaacccgcgttaccaccctagcatcctttaatgactctgccgttttgcagatggctctgacttgccgcgtgcgccttcccgttctacactatcgaggaagatctcgtcgtaggagaggcatggcgggcagtggtcgccgacgggctttgcgcaggcgcatgaaaggcggaattttacccgccctgatacccataatcgccgccgccatcggtgccatacccggcgttgcttcagtggccttgcaagcagctcgtaataaataaacgaaggcttttgcacttatgtcctggtcctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggaacagtagtgctggtcagatgctccgagataaactgaaggacaccaacttccaagaaaaagtggtcaatggggtggtgaccggcattcacggcgcggtagatctcgccaaccaagcggtgcagaaagagattgacaggcgtttggaaaactcgcgggtgccgccgcagagaggggatgaggtggaggtcgaggaagtagaagtagaggaaaagctgcccccgctggaaaaagttcccggtgcgcctccgagaccgcagaagcggcccaggccagaactagaagagactctggtgacggagagcaaggaacctccctcgtacgagcaagccttgaaagagggcgcctctccaccctcctacccgatgactaagccgatcgcacccatggctcgaccggtgtacgggaaggactacaagcctgtcacgctagagctccccccgccaccaccgccccccacgcgcccgaccgttccccccctgccggctccgtcggcggccgcggcgggacccgtgtccgcacccgtcgccgtgcctctgccagccgcccgcccagtggccgtggccactgccagaaaccccagaggccagagaggagccaactggcaaagcacgctgaacagcatcgtgggcctgggggtgaaaagcctgaaacgccgccgttgctattattaaaagtgtagctaaaaaatttcccgttgtatacgcctcctatgttaccgccagagacgcgtgactgtcgccgcgagtgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaaccccaccgtggcccccacccacgatgtgaccacggaccgctcgcagaggctgaccctgcgctttgtgcccgtagaccgggaggacaccgcgtactcttacaaagtgcgctacacgctggccgtaggggacaaccgagtgctggacatggccagcacctactttgacatccggggggtgctggatcggggtcccagctttaagccctactccggaaccgcttacaactccctggctcccaagggtgctcccaaccctgcagaatgggaaaattctgacaacaagctaaaagtgagggctcaggcgccttttgttagctcttacggtgccactgcaattacaaaggatggtattcaagttggagtagtattaacagactcgacacagacgccacagtatgcggataaaacgtatcagcctgagccgcaaattggggaactacagtggaacagcgaagtgggaaacgatgataaagtagcaggcagggttctaaagaaaacaacacctatgtttccttgttacggttcatatgccaagcctaccaacgacaaaggagggcaggcaacacagcccgctgctggtcaagacgctcagaatgcagtagaattacagttctttgctactactagcgccaccaccactccaaaagcggtgttatacgctgaggatgtgtccattgaaacaccagacacccaccttgtgttcaagccaacagtaactgcgggaactacaagttcagaagctttgctgtcccaacaagccgctcccaaccgaccaaactacattgccttcagagataactttatcggccttatgtactacaacagcacgggaaacatgggagtactggccggtcaggcatcccagttaaatgccgtggttgatttgcaagacagaaatactgaactgtcatatcagctaatgttggacgcgctgggagaccgcagtcgctacttctctatgtggaaccaagctgttgacagttacgatccagatgtgagaatagtggaaaatcacggcgtagaagatgaattgccaaattattgctttccattgggcggaacggtagttacggatacctacacgcccatacagccaaatagcaatggaggaggcacatgggttgcaaaagataacgtttttacagatagaggagtggaaataagctcaggtaatatgtttgccatggaaattaacctacaagccaacctctggcgcagctttttgtattccaatattggattgtacctcccagacaccctgaaaataacccccgacaacattacgctgccagagaacaaaaacacctaccagtacatgaacggacgggtaacgccgcccggactcgtggacacctacgttaacgtgggcgcgcgctggtcccccgatgtcatggacagcatcaaccccttcaaccaccaccgcaacgccgggctccgctaccgttccatgctccttggcaacggccgctacgtgcccttccacattcaggtgcctcagaaattctttgccattaagaacctgttactgctccccggttcctacacctacgagtggaacttccgcaaggacgttaatatgatcttgcagagctcgctgggcaatgacctgcgagtggacggggcgagcatccgcttcgacagcattaacctgtacgccaactttttccccatggcccacaacacggcctccaccctggaagccatgctgcgcaacgacaccaacgaccaatctttcaacgactacctgtgcgcggccaacatgctgtaccccatccccgccaacgccaccagcgtgcccatctccattccctctcgcaactgggcagccttcaggggctggagttttacccgcctcaaaaccaaggagaccccctcgctgggctccgggttcgacccctacttcgtctactccggctccatcccctacctggacggcaccttctacctcaaccatactttcaaaaaggtgtcaatcatgttcgactcgtcggtcagctggcccggcaacgaccgtctgctgacgcccaacgagttcgaaatcaagcgttcggtggacggtgaagggtacaacgtggcccagagcaacatgaccaaggactggttcttaattcagatgctcagccattacaacatcggctaccagggtttctacgtgcccgagaattacaaagaccgcatgtactccttctttagaaacttccaacctatgagccgtcaagtagtagatactgtggcttataaggactactatcaggacgttaagctcccctaccagcacaacaactcagggttcgtgggctacatgggtcccaccatgcgagaggggcaggcctacccggccaattatccctatcccctgatcggggccaccgccgtacccagcctgacgcagaaaaagttcctctgcgaccgggtgatgtggaggatccccttctctagcaactttatgtctatgggctccctcaccgacctggggcagaacatgctgtacgccaactccgctcacgctttagatatgacctttgaggtggatcccatggatgagcccacgcttctctatgttctgtttgaagtcttcgacgtggtgcgcatccaccagccgcaccgcggcgtcatcgaggccgtctacctgcgcacacctttctctgccggtaacgccaccacctaaagaagctgatgggctccagcgaacaggagctgcaggccattgttcgcgacctgggctgcgggccctactttttgggcaccttcgacaagcgttttcccggctttatgtccccccacaagccggcctgcgccatcgttaacacggccggacgggagaccgggggggtccactggctcgccttcgcctggaacccgcgtaaccgcacctgctacctgttcgacccttttggcttctccgacgaaaggctgaagcagatctaccagttcgagtacgaggggctcctcaagcgcagcgctctggcctccacgcccgaccactgcgtcaccctggaaaagtccacccagacggtccaggggcccctctcggccgcctgcgggctcttctgttgcatgtttttgcacgccttcgtgcactggcctcacacccccatggagcgcaaccccaccatggatctgctcaccggagtgcccaacagcatgcttcacagcccccaggtcgcccccaccctgcgccgtaaccaggaacacctgtatcgctttctggggaaacactctgcctattttcgccgccaccggcagcgcatcgaacgggccacggccttcgaaagcatgagccaaagagtgtaatcaataaaaaccatttttattttaacatgacacgcgcttctggcgtttttattaaaaatcgaagggttcgagggaggggtcctcgtgcccgctggggagggacacgttgcgatactggaaacgggcgctccaacgaaactcggggatcaccagccgcggcaggggcacgtcttccaggttctgcttccaaaactgccgcaccagctgcagggctcccatgacgtcgggcgccgatatcttgaagtcgcagttagggccggagctcccgcggctgttccggaacacggggttggcacactggaacaccatcacgctggggttgtggatactagccagggccgtcgggtcggtcacctccgacgcatccagatcctcggcgttgctcagggcgaacggggtcagcttgcacatctgccgcccgatctggggcaccaggtcgggtttgttgaggcaatcgcagcgcagagggatgaggatgcgacgctgcccgcgttgcatgatagggtaactcgctgccaggaactcctccatctgacggaaggccatctgggccttcgtgccctcggtgaaaaagagcccgcaggacttgctagagaatacgttatgaccgcagttgacgtcctccgcgcagcagcgggcgtcttcgttcttcagctgaaccacgttgcggccccaacggttctggaccaccttggctttcgtaggatgctccttcaacgcccgctgaccgttctcgctggtcacatccatttccaccacgtgctccttgcagaccatctccactccgtggaaacagaacaggacgccctcctgccgggtattgcgatgctcccacacggcgcacccggtgggctcccagctcttgcgtttcacccccgcgtatgcttccatgtaagccatgaggaatctgcccatcagctcggtgaaggtcttctggttggtgaaggtcagcggcaggccgcggtgctcctcgttcaaccaagtttgacagatcttgcggtacacggttccctggtcgggcagaaacttaaaagcccctctgctctcgttgtccacgtggaacttctccatcaacatcgtcatgacttccatgcccttctcccaggcagtcaccagcggcgcgctctcggggttcttcaccaacacggcggtggaggggccctcgccggccccgacgtccttcatggtcattctttgaaactccacggtgccgtccgcgcggcgtactctgcgcatcggagggtagctgaagcccacctccaccacggtgccttcgccctcgctgtcggaaacgatctccggggagggcggcggcgcgggtgtcgccttgcgagccttcttcttgggagggagcggaggcacctcctgctcgcgctcggggctcatctcccgcaagtagggggtgatggagcttcccgcttggttctgacggttggccattgtatcctaggcagaaagacatggatcttatgcgcgaggaaactttaaccgccccgtcccccgtcagcgacgaagaggtcatcgtcgaacaggacccgggctacgttacgccgcccgaggatctggaggggcctgaccggcgcgacgctagtgagcggcaggaaaatgagaaagaggaggcctgctacctcctggaaggcgacgtcttgctaaagcatttcgccaggcagagcaccatactcaaggaggccttgcaagaccgctccgaggtgcccttggacgtcgccgcgctctcccaggcctacgaggcgaaccttttctcgcctcgagtgcctccgaagagacagcccaacggcacctgcgagcccaacccgcggctcaacttctaccccgtgttcgccgtgcccgaggcgctggccacctaccacatctttttcaaaaaccagcgcattcccctttcctgccgggccaaccgcaccgcggccgataggaagctaacactcagaaacggagccagcatacctgatatcacgtcactggaggaagtgcctaagatcttcgagggtctgggtcgagatgagaagcgggcggcgaacgctctgcagaaagaacagaaagagagtcagaacgtgctggtggagctggagggggacaacgcgcgtctggccgtcctcaaacgctgcatagaagtctcccacttcgcctaccccgccctcaacttgccacccaaagttatgaaatcggtcatggatcagctgctcatcaagagagctgagcccctggatcccgaccaccctgaggtggaaaactcagaggacggaaagcccgtcgtcagcgacgaggagctcgagcggtggctggaaaccagggacccccaacagttgcaagagaggcgcaagatgatgatggcggccgtgctggtcaccgtggagctggaatgcctgcaacggtttttcagcgacgtggagacgctacgcaaaatcggggaatccctgcactacaccttccgccagggctacgtccgccaggcctgcaagatctccaacgtggagctcagcaacctggtctcctacatgggcatcctccacgagaaccggctgggacagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgtcctggaacgctccgggatcttgcccgccatgagctgcgcgctaccttctgactttgtccccctctcctaccgcgagtgccctcccccactgtggagccactgctacctcttccaactggccaactttctggcctaccactccgacctcatggaagacgtaagcggagagggtttactggagtgccactgccgctgcaacctgtgcaccccccacagatcgctggcctgcaacaccgagctactcagcgaaacccaggtcataggtaccttcgagatccaggggccccagcagcaagagggtgcttccggcttgaagctcactccggcgctgtggacctcggcttacttacgcaaatttgtagccgaggactaccacgcccacaaaattcagttttacgaagaccaatctcgaccaccgaaagcccccctcacggcctgcgtcatcacccagagcaagatcctggcccaattgcaatccatcaaccaagcgcgccgcgatttccttttgaaaaagggtcggggggtgtacctggacccccagaccggcgaggaactcaacccgtccacactctccgtcgaagcagcccccccgagacatgccgcccaagggaaccgccaagcagctgatcgctcggcagagagcgaagaagcaagagctgctccagcagcaggtggaggacgaggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccgaatctccagcggcagcggcaacggcagcgggtaaggccaaacgcgagcggcgggggtattgctcctggcgggcccacaaaagcagtattgtgaactgcttgcaacactgcgggggaaacatctcctttgcccgacgctacctcctcttccatcacggtgtggccttccctcgcaacgttctctattattaccgtcatctctacagcccctacgaaacgctcggagaaaaaagctaaggcctcctctgccgcgaggaaaaactccgccgccgctgccgccgccaaggatccaccggccaccgaagagctgagaaagcgcatctttcccactctgtatgctatctttcagcaaagccgcgggcagcaccctcagcgcgaactgaaaataaaaaaccgctccttccgctcgctcacccgcagctgtctgtaccacaagagagaagaccagctgcagcgcaccctggacgacgccgaagcactgttcagcaaatactgctcagcgtctcttaaagactaaaagacccgcgctttttccccctcggccgccaaaacccacgtcatcgccagcatgagcaaggagattcccaccccctacatgtggagctatcagccccagatgggcctggccgcgggggccgcccaggactactccagcaagatgaactggctcagcgccggcccccacatgatctcacgagttaacggcatccgagcccaccgaaaccagattctcttagaacaggcggcaatcaccgccacaccccggcgccaactcaacccgcctagttggcccgccgcccaggtgtatcaggaaaatccccgcccgaccacagtcctcctgccacgcgacgcggaggccgaagtcctcatgactaactctggggtacaattagcgggcgggtccaggtacgccaggtacagaggtcgggccgctccttactctcccgggagtataaagagggtgatcattcgaggccgaggtatccagctcaacgacgagacggtgagctcctcaaccggtctcagacctgacggagtcttccagctcggaggagcaggccgctcttccttcaccactcgccaggcctacctgaccctgcagagctcttcctcgcagccgcgctccgggggaatcggcactctccagttcgtggaagagttcgttccctccgtctacttcaaccccttctccggctcgcctggacgctacccggacgccttcattcccaactttgacgcagtgagtgaatccgtggacggctacgactgatgacagatggtgcggccgtgagagctcggctgcgacatctgcatcactgccgtcagcctcgctgctacgctcgggaggcgttcgtgttcagctactttgagctgccggacgagcaccctcagggaccggctcacgggttgaaactcgagatcgagaacgcgatcgagtctcgcctcatcgacgccttcaccgcccgacctctcctggtagaaaccgaacgcgggaacactaccatcaccctgttctgcatctgccccacgcccggattacatgaagatctgtgttgtcatctttgcgctcagtttaataaaaactgaactttttgccgcaccttcaacgccatctgtgatttctacaacaaaaagttcttctggcaaaggtacacaaactgtattttattctaattctacctcatctatcgtgctgaactgcgcctgcgctaacgaacttatcgacctgtcgagggggctatcctgtgccactgtcacgcgcctgattgcatgtcaaaactaatcagaacgctctgtgctttaggtgatatttttaaaatgtaagtcagtatcaataaacttaccttaaatttgacagcagttttttggtaacatcattcagcagcaccactttaccctcttcccagctctcatatgggatacgatattgggcggcaaactttctccaaaccctaaacgaaacgttagtatgtatttgcttatcactacccatgattttcatctttcacagatgaaaaggaccagagttgatgaagactttaaccctgtctacccttacgatgcagaacaaagttcctcagttccctttgtaaccccgcccttcacatcctccaatggcttaacagaatccccttcgggagtattaactcttaactatagtcagcccttaacaacaatcaacggtaaactaacacttaacgtggacggcggacttaatataaacaacgataaaaaacttcaagttcgcaccaatgaaaacgagggagttaccttgcaaaacaacgcagtgtcagttaaaataggaaatgaccttagatttgactcccgagggcaaattactctaaaccccgtttctttatggaccactcccagtgaaagcgccaactgcacactttacaactccagtgccaactttttcttatgtctcacaagaaacgatgctcacgtcgttggcaccgtcaatcttacaggaatcaacggaaagttctccagcatgacagaaaacagtgtaatagttcagctagccttcgatgaaaacggcacacttcaatcatctccgttagctcaaaacgtttgggcatacgtcaaactcctaactctccaaacgctgttaatttgcttacatttatgcccagcagcttagtgtaccctagagaaggtggaggaaaaccaaaaaataacttgtatttcaacacattcttgcgaggcaacctgagcaggccaattacccttacgctcacactcaactcactccctacaggttacacgcttacattcaagtgggggacttaccttaacgaaccgttctctgtaccaactacgtgtttctgctatgttgcagaacaataaaaaacataaatcctaactttgatttttcagatgaaacgcgctcgtgttgacgaaagcttcaaccccgtttacccctatgactccacatctactcccgctatcccatttgtaacccctccatttgttagcaacgatggccttcaggaaaaccctcccggcatactaagtttgcagatcgccaaaccactgtttttcaacacacaaagaaaaattgccctttcgctgggaagaggtcttgctattacaagcgctggcgaactagaaaacacgcaacggatacaaagcactcctccgttattgctaaacagcaacactctttcaatgaactactcctctcctcttacagtccttgacaacaagctagcactaaactacttgtctccccttcgtgttgtaaatgacagccttacatttaattttacttccccactccatgtagctgatggtaaccttacctttagttatacctccccccttcatgtaacaaacaatagcctggctttaaactactccgcaccgttacgtttgcttaacaacagccttacttttacctacgcaaacccgtttaaaatcgctaactcaagcctctctctaaaacttgattatccgtcagctctccgtttaaacaacaatggcagcttacaggtaatagcagggtgggggctaggtatagccggcaataacgacctgtatgtaaagcgacaggctcccttagccgtctatgaaagcggctccaacgctggaaccttgtacttgcgtttaggtccaaattctgctttaagaactgttaatgacaatctcaccctgaacaccggccaggggctacagataacaaacaatactctttctgttaaactaggtaatggtttgcgtttcaacaacactggagccattgaacttgcacaataaaacctgttgtccaaagattaaacatttgtttttcagatgaaacgagccagagttgacgaagacttcaaccccgtgtacccttacgatcccccgtatgctccaattatgccattcattactcccccattcacctcttctgatggcttgcaagaaaaacctttcggagtactaagtataaattacaaggatcccatcacaacccagaacggttctttgactttaaaagttggaaacggcctaagtataaacaaccagggccagcttacatccacccaaacaaccgtcactcctccactaacaaatgaaagtgacacactaggactcgcctacagtgaccctctcaccgtaaaaaacaactcgctaactttgtcccacagcgcaccgtttgctgtttctaatcattctttgagtctcaaaacaacaacccctttttttattaatcagcaaaatgagcttgcattatccaccgacgcccctcttcaggttaccgccggcagccttcgcctccaaagtgccgctcccttgggaatagctgaacaaacactcagactcctgttttcaaatcctcttttcttgcaagacaattttttaaccctagctattgaacgcccactggccataacttccagcggtaatttaactgtgcagctaaacccaccctttcaatcaaccagtactggcctagctttatccctttctaaccccctcacaatttctaatggaaccttagccatgtcaataaaacgaccgttcatcatagatgataacaagttatacatggatttcagacctccgctacgactatttaacagcgagccccaactgggcgtacactttaatccccctatcaccgtgcaacaaggcggtctggccttaaatacgggggatggtttgcaagtatatcttaacaaactaacgctaaacataggcagagacttgcaatatgaaaacgggtcactagtcgttaagttaacacccgctccgcccctccagtacaccacccaactacaacttaacatgggagctggattacacctgggcgctacaaaacagcttacactggatgttgatacaaacaggggcctcacttggaataacaataaactagccgttaacttaggagacggcctgcaattcaattcgtatggtcaaataatccccactgttaaaaaagacacattgtggactacagcagatccatctcctaattgttctatatataaggatttggatgccaaactttggctttcattagtgaaaagcggaggaatggtgcatggctccattgctttacaagctctaaaggacacgctactgagtcccacagacagttttataactattatactgtattttgatgaaaacggtgtacgtgctccttacccaacttttgacaacgaaggaactttagccaaggatgccacttggggctatagacaaggcccctcggctgacactaatgttaccaatgcgctcgaatttatgcctagctctgcgaggtatccgcgagggaagcatgaacaagcgcagaatcaaacatttggatacacctgcttacagggcaacttttcttggcctataccatttcgagtgcaatacaattatgtgcgtactggtttctcatttaagtttacctggcaagttgtaaacagacaaaaatttgatattccttgctgttcattctcttatatcacagaacaataaaacacctttttccttttttattttctttttattttacacgtacagtaaggcttcctccacccttccatttgacagcatataccagcctctcccccttcatggcagtaaactgttgtgagtcagtccggtatttgggagttaagatccaaacagtctctttggtaatcagatgtcgatccgtgatggacacaaatccctggggcaggttctccaacgtttcggtgaaaaactgcgtgccgccctacaaaacaaacaggttcaggctctccacgggttatctccccgatcaaactcagacagggtaaaggtgcgatgatgttccactaaaccacgcaggtggcgctgtctgaacctctcggtgcgactcctgtgaggctggtaagaagttagattgtccagcagcctcacagcatggatcatcagtctacgagtgcgtctggcgcagcagcgcatctgaatctcactgagattccggcaagaatcgcacaccatcacaatcaggttgttcatgatcccatagctgaacacgctccagccaaagctcattcgctccaacagcgccaccgcgtgtccgtccaaccttactttaacataaatcaggtgtctgccgcgtacaaacatgctacccgcatacagaacctcccggggcagtcccctgttcaccacctgcctgtaccagggaaacctcacatttatcagggagccatagatagccatcttaaaccaattagctaacaccgccccaccagctctacactgaagagaaccgggagagttacaatgacagtgaataatccatctctcataacccctaatggtctgatggaaatccagatctaacgtggcacagcagatacacactttcatatacattttcatcacatgtttttcccaggccgttaaaatacaatcccaatacacgggccactcctgcagtacaataaagctaatacaagatggtatactcctcacctcactaacattgtgcatgttcatattttcacattctaagtaccgagagctctcctctacaacagcactgccgcggtcctcacaaggtggtagctggtgacaattgtagggagccagtctgcagcgataccgtctgtcgcgttgcatcgtagaccagggaccgacgcacttcctcgtacttgtagtagcagaaccacgtccgctgccagcacgtctccaagtaacgccggtccctgcgtcgctcacgctccctcctcaacgcaaagtgcaaccactcttgtaatccacacagatccctctcggcctccggggcgatgcacacctcaaacctacagatgtctcggtacagttccaaacacgtagtgagggcgagttccaaccaagacagacagcctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaggactgtacaatgcccaagtaattttcatttctccactcgcgaatgatgtcgcggcaaatagtctgaaggttcatgccgtgcatattaaaaagctccgaaagggcgccctctatagccatgcgtagacacaccatcatgactgcaagatatcgggctcctgagacacctgcagcagatttaacagacccaggtcaggttgctctccgcgatcgcgaatctccatccgcaaggtcatttgcaaataattaaatagatctgcgccgactaaatctgttaactccgcgctaggaactaaatcaggtgtggctacgcagcacaaaagttccagggatggcgccaaactcactagaaccgctcccgagtagcaaaactgatgaatgggagtaacacagtgtaaaatgttcagccaaaaatcactaagccgctcctttaaaaagtccagtacttctatattcagttcgtgcaagtactgaagcaactgtgtgggaatatgcacaacaaaaaaaatagggcggctcagatacatgttgacctaaaataaaaagaatcattaaactaaagaagcttggcgaacggtgggataaatgacacgctccagcagcaggcaagcaaccggctgtccccgggaaccgcggtaaaattcatccgaatgattaaaaagaacaacagaaacttcccaccatgtactcggttggatctcctgagcacagagcaatacccccctcacattcatatccgccacagaaaaaaagcgtcccaaatacccagcgggaatatccaacgacagctgcaaagacagcaaaagaatccctctgggagcaatcacaaaatcctccggtgaaaaaagcacatacatattagaataaccctgttgctggggcaaaaaggcccgtcgtcccagcaaatgcacataaatatgttcatcagccattgccccgtcttaccgcgtataaagccacgaaaaagtcgagctaaaatccacccaacagcctatagctatatatacactccgcccaatgacgctaacaccgcaccacccacgaccaaagttcacccacacccacaaaacccgcgaaaatccagcgccgtcagcacttccgcaatttcagtctcacaacgtcacttccgcgcgccttttttcactattcccacacccgccctcgcgccaccccgcgtcaccccacgtcaccgcacgtcaccgcacgtcaccccggccccgcctcgctcctccccgctcattatcatattggcacgtttccagaataaggtatattattgatgatgttaattaagacaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttggggtcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatccggaccaaagcggccatcgtgcctccccactcctgcagttcgggggcatggatgcgcggatagccgctgctggtttcctggatgccgacggatttgcactgccggtagaactccgcgaggtcgtccagcctcaggcagcagctgaaccaactcgcgaggggatcgagcccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccggatctgcaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaatcctgatataaagacaggttgataaatcagtcttctacgcgcatcgcacgcgcacaccgtagaaagtctttcagttgtgagcctgggcaaaccgttaactttcggcggctttgctgtgcgacaggctcacgtctaaaaggaaataaatcatgggtcataaaattatcacgttgtccggcgcggcgacggatgttctgtatgcgctgtttttccgtggcgcgttgctgtctggtgatctgccttctaaatctggcacagccgaattgcgcgagcttggttttgctgaaaccagacacacagcaactgaataccagaaagaaaatcactttacctttctgacatcagaagggcagaaatttgccgttgaacacctggtcaatacgcgttttggtgagcagcaatattgcgcttcgatgacgcttggcgttgagattgatacctctgctgcacaaaaggcaatcgacgagctggaccagcgcattcgtgacaccgtctccttcgaacttattcgcaatggagtgtcattcatcaaggacgccgctatcgcaaatggtgctatccacgcagcggcaatcgaaacacctcagccggtgaccaatatctacaacatcagccttggtatccagcgtgatgagccagcgcagaacaaggtaaccgtcagtgccgataagttcaaagttaaacctggtgttgataccaacattgaaacgttgatcgaaaacgcgctgaaaaacgctgctgaatgtgcggcgctggatgtcacaaagcaaatggcagcagacaagaaagcgatggatgaactggcttcctatgtccgcacggccatcatgatggaatgtttccccggtggtgttatctggcagcagtgccgtcgatagtatgcaattgataattattatcatttgcgggtcctttccggcgatccgccttgttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgcggcaggccagcgaggcagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagcggtcaaacatgagaattgcggttaattaa

SEQ ID NO: 264 - protein, 561 aa, Artificial Sequence
  Seq_264 is a consensus majority sequence of SEQ ID NOs: 144-157
  MISC_FEATURE (4)..(4): Xaa is Ala or Val
  MISC_FEATURE (6)..(6): Xaa is Val or Ile
  MISC_FEATURE (7)..(7): Xaa is Glu or Asp
  MISC_FEATURE (18)..(18): Xaa is Pro or Ser
  MISC_FEATURE (20)..(20): Xaa is Tyr, Asn, or His
  MISC_FEATURE (23)..(23): Xaa is Ile or Val
  MISC_FEATURE (42)..(42): Xaa is Leu or Phe
  MISC_FEATURE (47)..(47): Xaa is Leu or Ile
  MISC_FEATURE (50)..(50): Xaa is Lys or Arg
  MISC_FEATURE (51)..(51): Xaa is Asp or Asn
  MISC_FEATURE (53)..(53): Xaa is Ile or Val
  MISC_FEATURE (62)..(62): Xaa is Leu, Ile, or Val
  MISC_FEATURE (64)..(64): Xaa is Leu, Val, or Ile
  MISC_FEATURE (66)..(66): Xaa is Asn or Ser
  MISC_FEATURE (69)..(69): Xaa is Asn, Thr, or Ser
  MISC_FEATURE (70)..(70): Xaa is Leu or Ile
  MISC_FEATURE (71)..(71): Xaa is Asp or Asn
  MISC_FEATURE (72)..(72): Xaa is Asp or Asn
  MISC_FEATURE (75)..(75): Xaa is Gln or Glu
  MISC_FEATURE (80)..(80): Xaa is Ala or Gln
  MISC_FEATURE (81)..(81): Xaa is Gly or Thr
  MISC_FEATURE (82)..(82): Xaa is Glu, Ala, or Thr
  MISC_FEATURE (84)..(84): Xaa is Glu, Thr, or Gln
  MISC_FEATURE (90)..(90): Xaa is Asn, Glu, or Ala
  MISC_FEATURE (91)..(91): Xaa is Asn, Asp, or Ser
  MISC_FEATURE (92)..(92): Xaa is Asn or Asp
  MISC_FEATURE (93)..(93): Xaa is Lys or Thr
  MISC_FEATURE (95)..(95): Xaa is Ala, Gly, or Thr
  MISC_FEATURE (97)..(97): Xaa is Ala or Val
  MISC_FEATURE (100)..(100): Xaa is Gln, Asp, or Glu
  MISC_FEATURE (103)..(103): Xaa is Ala or Thr
  MISC_FEATURE (105)..(105): Xaa is Lys, Gln, or Glu
  MISC_FEATURE (106)..(106): Xaa is Asn, Arg, or Ser
  MISC_FEATURE (107)..(107): Xaa is Asn or Lys
  MISC_FEATURE (108)..(108): Xaa is Arg or Ser
  MISC_FEATURE (109)..(109): Xaa is Leu or Ile
  MISC_FEATURE (110)..(110): Xaa is Thr or Ile
  MISC_FEATURE (111)..(111): Xaa is Leu or Val
  MISC_FEATURE (113)..(113): Xaa is His or Tyr
  MISC_FEATURE (114)..(114): Xaa is Asn, Ser or Thr
  MISC_FEATURE (117)..(117): Xaa is Leu or Phe
  MISC_FEATURE (118)..(118): Xaa is Val or Ala
  MISC_FEATURE (119)..(119): Xaa is Val or Ile
  MISC_FEATURE (120)..(120): Xaa is Thr, Ala, or Ser
  MISC_FEATURE (121)..(121): Xaa is Gly, Asn, or Asp
  MISC_FEATURE (122)..(122): Xaa is Asn, His, or Asp
  MISC_FEATURE (125)..(125): Xaa is Gly, Ala, or Ser
  MISC_FEATURE (127)..(127): Xaa is Gln or Lys
  MISC_FEATURE (128)..(128): Xaa is Val or Thr
  MISC_FEATURE (129)..(129): Xaa is Ser or Thr
  MISC_FEATURE (130)..(130): Xaa is Glu, Asp, or Thr
  MISC_FEATURE (132)..(132): Xaa is Ile or Phe
  MISC_FEATURE (135)..(135): Xaa is Asn or Asp
  MISC_FEATURE (136)..(136): Xaa is Asp, Ala, or Gln
  MISC_FEATURE (137)..(137): Xaa is Asn, Gln, Lys, or Asp
  MISC_FEATURE (138)..(138): Xaa is Asn or Asp
  MISC_FEATURE (139)..(139): Xaa is Lys or Glu
  MISC_FEATURE (143)..(143): Xaa is Gln or Ser
  MISC_FEATURE (145)..(145): Xaa is Asp or Ala
  MISC_FEATURE (149)..(149): Xaa is Gln, Lys, Asn, or Val
  MISC_FEATURE (150)..(150): Xaa is Thr or Val
  MISC_FEATURE (151)..(151): Xaa is Asn or Thr
  MISC_FEATURE (152)..(152): Xaa is Ala or Thr
  MISC_FEATURE (154)..(154): Xaa is Ser, Thr, or Val
  MISC_FEATURE (165)..(165): Xaa is Ile or Leu
  MISC_FEATURE (166)..(166): Xaa is Ala or Val
  MISC_FEATURE (167)..(167): Xaa is Asp or Glu
  MISC_FEATURE (168)..(168): Xaa is Gln, Asn, or Glu
  MISC_FEATURE (171)..(171): Xaa is Asn, Lys, or Arg
  MISC_FEATURE (175)..(175): Xaa is Thr, Ser, or Ala
  MISC_FEATURE (176)..(176): Xaa is Asn or Lys
  MISC_FEATURE (179)..(179): Xaa is Tyr or Phe
  MISC_FEATURE (182)..(182): Xaa is Gly, Asp, or Asn
  MISC_FEATURE (183)..(183): Xaa is Asp or Asn
  MISC_FEATURE (186)..(186): Xaa is Thr, Ser, or Ala
  MISC_FEATURE (188)..(188): Xaa is Gly or Ala
  MISC_FEATURE (195)..(195): Xaa is Ile or Val
  MISC_FEATURE (196)..(196): Xaa is Ala or Thr
  MISC_FEATURE (197)..(197): Xaa is Asn, Ser, or Ala
  MISC_FEATURE (198)..(198): Xaa is Thr, Ser, Ala, or Asp
  MISC_FEATURE (200)..(200): Xaa is Asn, Lys, Thr, or Ser
  MISC_FEATURE (202)..(202): Xaa is Ala or Thr
  MISC_FEATURE (203)..(203): Xaa is Leu or Val
  MISC_FEATURE (204)..(204): Xaa is Ala or Gln
  MISC_FEATURE (206)..(206): Xaa is Asn, Ser, Thr, or Asp
  MISC_FEATURE (209)..(209): Xaa is Leu or Phe
  MISC_FEATURE (210)..(210): Xaa is Gln, Lys, or Thr
  MISC_FEATURE (211)..(211): Xaa is Thr or Ser
  MISC_FEATURE (212)..(212): Xaa is Ala, Thr, Asn, or Ser
  MISC_FEATURE (213)..(213): Xaa is Ser, Asp, or Asn
  MISC_FEATURE (214)..(214): Xaa is Thr, Asp, or Ser
  MISC_FEATURE (217)..(217): Xaa is Thr, Ala, or Gly
  MISC_FEATURE (218)..(218): Xaa is Leu or Ile
  MISC_FEATURE (219)..(219): Xaa is Gln, Ser, or Leu
  MISC_FEATURE (220)..(220): Xaa is Thr or Leu
  MISC_FEATURE (221)..(221): Xaa is Asn, Ser, Val or Ala
  MISC_FEATURE (222)..(222): Xaa is Val, Asn, Glu, Asp, or Ala
  MISC_FEATURE (224)..(224): Xaa is Val or Leu
  MISC_FEATURE (226)..(226): Xaa is Val or Ile
  MISC_FEATURE (227)..(227): Xaa is Ser, Lys, or Thr
  MISC_FEATURE (230)..(230): Xaa is Thr or Asn
  MISC_FEATURE (232)..(232): Xaa is Gly, Ala, or Asn
  MISC_FEATURE (233)..(233): Xaa is Leu or Met
  MISC_FEATURE (234)..(234): Xaa is Gln, Ser, Arg, or Asn
  MISC_FEATURE (235)..(235): Xaa is Val or Ile
  MISC_FEATURE (236)..(236): Xaa is Ser or Lys
  MISC_FEATURE (239)..(239): Xaa is Leu or Phe
  MISC_FEATURE (240)..(240): Xaa is Val or Ile
  MISC_FEATURE (241)..(241): Xaa is Val or Ile
  MISC_FEATURE (242)..(242): Xaa is Gln or Asp
  MISC_FEATURE (243)..(243): Xaa is Asp or Asn
  MISC_FEATURE (244)..(244): Xaa is Asn or Ser
  MISC_FEATURE (245)..(245): Xaa is Asn, Lys, or Ser
  MISC_FEATURE (247)..(247): Xaa is Ser, Tyr, or Phe
  MISC_FEATURE (248)..(248): Xaa is Leu or Met
  MISC_FEATURE (249)..(249): Xaa is Ala or Asp
  MISC_FEATURE (250)..(250): Xaa is Phe, Ile, or Leu
  MISC_FEATURE (251)..(251): Xaa is Arg or Thr
  MISC_FEATURE (252)..(252): Xaa is Pro or Ala
  MISC_FEATURE (258)..(258): Xaa is Asn or Asp
  MISC_FEATURE (260)..(260): Xaa is Glu or Asp
  MISC_FEATURE (262)..(262): Xaa is Val or Gln
  MISC_FEATURE (265)..(265): Xaa is Leu or Val
  MISC_FEATURE (266)..(266): Xaa is Asn, Gly, or His
  MISC_FEATURE (268)..(268): Xaa is Tyr, Thr, or Asn
  MISC_FEATURE (269)..(269): Xaa is Thr, Pro, Ser, or Phe
  MISC_FEATURE (271)..(271): Xaa is Ile or Leu
  MISC_FEATURE (272)..(272): Xaa is Thr or Ala
  MISC_FEATURE (274)..(274): Xaa is Thr, Arg, Val, or Gln
  MISC_FEATURE (275)..(275): Xaa is Asp, Gln, Ala, or Asn
  MISC_FEATURE (276)..(276): Xaa is Glu, Asp, Asn, or Gly
  MISC_FEATURE (277)..(277): Xaa is Ala, Gly, or Leu
  MISC_FEATURE (279)..(279): Xaa is Thr, Ala, or Ser
  MISC_FEATURE (280)..(280): Xaa is Leu or Val
  MISC_FEATURE (281)..(281): Xaa is Asn or Asp
  MISC_FEATURE (282)..(282): Xaa is Met, Ile, or Thr
  MISC_FEATURE (284)..(284): Xaa is Arg, Asn, or Gly
  MISC_FEATURE (287)..(287): Xaa is Gln, Thr, or Lys
  MISC_FEATURE (288)..(288): Xaa is Leu or Val
  MISC_FEATURE (289)..(289): Xaa is Ser, Tyr, or Leu
  MISC_FEATURE (290)..(290): Xaa is Tyr, Leu, or Phe
  MISC_FEATURE (291)..(291): Xaa is Asp or Asn
  MISC_FEATURE (292)..(292): Xaa is Lys or Gly
  MISC_FEATURE (295)..(295): Xaa is Leu or Ala
  MISC_FEATURE (297)..(297): Xaa is Leu or Ile
  MISC_FEATURE (299)..(299): Xaa is Lys or Arg
  MISC_FEATURE (302)..(302): Xaa is Arg, Gln, or Glu
  MISC_FEATURE (303)..(303): Xaa is Phe or Tyr
  MISC_FEATURE (304)..(304): Xaa is Asp, Glu, or Gln
  MISC_FEATURE (306)..(306): Xaa is Asn or Gly
  MISC_FEATURE (307)..(307): Xaa is Thr, Ala, or Ser
  MISC_FEATURE (308)..(308): Xaa is Val, Leu, or Ile
  MISC_FEATURE (309)..(309): Xaa is Ser, Ala, or Val
  MISC_FEATURE (311)..(311): Xaa is Ala, Thr, Arg, Ser, or Lys
  MISC_FEATURE (313)..(313): Xaa is Ser, Thr, or Asn
  MISC_FEATURE (314)..(314): Xaa is Ala, Pro, or Thr
  MISC_FEATURE (315)..(315): Xaa is Ala or Glu
  MISC_FEATURE (316)..(316): Xaa is Ala, Pro, or Leu
  MISC_FEATURE (322)..(322): Xaa is Asp, Asn, or Thr
  MISC_FEATURE (323)..(323): Xaa is Lys or Gln
  MISC_FEATURE (325)..(325): Xaa is Arg or Gln
  MISC_FEATURE (328)..(328): Xaa is Val, Met, Ile or Leu
  MISC_FEATURE (333)..(333): Xaa is Arg or His
  MISC_FEATURE (334)..(334): Xaa is Tyr or Leu
  MISC_FEATURE (335)..(335): Xaa is Asn or Gly
  MISC_FEATURE (336)..(336): Xaa is Pro, Gly, or absent
  MISC_FEATURE (337)..(337): Xaa is Ala or Val
  MISC_FEATURE (338)..(338): Xaa is Ser or Thr
  MISC_FEATURE (339)..(339): Xaa is Lys or Arg
  MISC_FEATURE (340)..(340): Xaa is Lys or Gln
  MISC_FEATURE (342)..(342): Xaa is Asp or Thr
  MISC_FEATURE (343)..(343): Xaa is Val or Leu
  MISC_FEATURE (344)..(344): Xaa is Asn or Asp
  MISC_FEATURE (345)..(345): Xaa is Pro, Ile, or Val
  MISC_FEATURE (346)..(346): Xaa is Asn or Asp
  MISC_FEATURE (347)..(347): Xaa is Glu, Gln, or Thr
  MISC_FEATURE (348)..(348): Xaa is Asn or Gln
  MISC_FEATURE (349)..(349): Xaa is Lys or Arg
  MISC_FEATURE (354)..(354): Xaa is Glu, Asn, or Asp
  MISC_FEATURE (355)..(335): Xaa is Asn or Gly
  misc_feature (355)..(355): Xaa can be any naturally occurring amino acid
  MISC_FEATURE (356)..(356): Xaa is Asp or Asn
  MISC_FEATURE (357)..(357): Xaa is Tyr, Gln, Ala, or Lys
  MISC_FEATURE (358)..(358): Xaa is Leu or Val
  MISC_FEATURE (359)..(359): Xaa is Ile, Val, or Ala
  MISC_FEATURE (360)..(360): Xaa is Val, Pro, or Ala
  MISC_FEATURE (361)..(361): Xaa is Ser, Lys, or Asn
  MISC_FEATURE (364)..(364): Xaa is Asn, Asp, Ser, Gln, or Thr
  MISC_FEATURE (367)..(367): Xaa is Gly, Gln, Tyr, or Ala
  MISC_FEATURE (369)..(369): Xaa is Asp or Asn
  MISC_FEATURE (370)..(370): Xaa is Gly, Ser, Pro, or Asn
  MISC_FEATURE (371)..(371): Xaa is Asp, Tyr, Asn, or Gln
  MISC_FEATURE (373)..(373): Xaa is Asn, Arg, or absent
  MISC_FEATURE (374)..(374): Xaa is Ile or absent
  MISC_FEATURE (375)..(375): Xaa is Ser, Ala, or Gln
  MISC_FEATURE (376)..(376): Xaa is Val, Ile, or Met
  MISC_FEATURE (377)..(377): Xaa is Val, Ser, or Ile
  MISC_FEATURE (378)..(378): Xaa is Ser or Pro
  MISC_FEATURE (379)..(379): Xaa is Gln, Thr, or Glu
  MISC_FEATURE (380)..(380): Xaa is Thr, Ala, Asn, or Val
  MISC_FEATURE (381)..(381): Xaa is Thr, Lys, or Ala
  MISC_FEATURE (382)..(282): Xaa is Lys, Gly, Ser, or absent
  misc_feature (382)..(382): Xaa can be any naturally occurring amino acid
  MISC_FEATURE (383)..(383): Xaa is Pro, Lys, or Asp
  MISC_FEATURE (384)..(384): Xaa is Asp or Gln
  MISC_FEATURE (397)..(397): Xaa is Thr or Ser
  MISC_FEATURE (398)..(398): Xaa is Ile or Val
  MISC_FEATURE (400)..(400): Xaa is Thr, Lys, Gln, or Glu
  MISC_FEATURE (401)..(401): Xaa is Asn, Asp, or Gln
  MISC_FEATURE (405)..(405): Xaa is Lys or Arg
  MISC_FEATURE (406)..(406): Xaa is Leu or Met
  MISC_FEATURE (409)..(409): Xaa is Ser or Ala
  MISC_FEATURE (413)..(413): Xaa is Cys, Gln, or Ser
  MISC_FEATURE (415)..(415): Xaa is Gly or Asp
  MISC_FEATURE (416)..(416): Xaa is Met or Val
  MISC_FEATURE (418)..(418): Xaa is Gln or His
  MISC_FEATURE (421)..(421): Xaa is Ile or Val
  MISC_FEATURE (424)..(424): Xaa is Gln or Lys
  MISC_FEATURE (426)..(426): Xaa is Leu, Gln, or Glu
  MISC_FEATURE (428)..(428): Xaa is Gly or Asp
  MISC_FEATURE (429)..(429): Xaa is Thr or Arg
  MISC_FEATURE (431)..(431): Xaa is Met or Leu
  MISC_FEATURE (432)..(432): Xaa is Asn or Ser
  MISC_FEATURE (433)..(433): Xaa is Val or Pro
  MISC_FEATURE (435)..(435): Xaa is Ala, Glu, or Asp
  MISC_FEATURE (436)..(436): Xaa is Pro or Ser
  MISC_FEATURE (437)..(437): Xaa is Ala, Tyr, Ser, or Phe
  MISC_FEATURE (438)..(438): Xaa is Ile or Val
  MISC_FEATURE (439)..(439): Xaa is Val, Ser, or Thr
  MISC_FEATURE (441)..(441): Xaa is Ile or Val
  MISC_FEATURE (442)..(442): Xaa is Ile, Leu, or Met
  MISC_FEATURE (443)..(443): Xaa is His or Tyr
  MISC_FEATURE (445)..(445): Xaa is Asp, Tyr, or Asn
  MISC_FEATURE (446)..(446): Xaa is Asn, Ser, Glu, Asp, or Arg
  MISC_FEATURE (447)..(447): Xaa is Tyr or Asn
  MISC_FEATURE (450)..(450): Xaa is Arg or Trp
  MISC_FEATURE (451)..(451): Xaa is Ile, Arg, or absent
  MISC_FEATURE (452)..(452): Xaa is Leu, Ala, Thr, or Ile
  MISC_FEATURE (453)..(453): Xaa is Asn, Pro, or Asp
  MISC_FEATURE (457)..(457): Xaa is Phe, Leu, or Ile
  MISC_FEATURE (458)..(458): Xaa is Gly or absent
  MISC_FEATURE (459)..(459): Xaa is Asp or Gly
  MISC_FEATURE (460)..(460): Xaa is Thr, Asn, or Asp
  MISC_FEATURE (461)..(461): Xaa is Gln or Glu
  MISC_FEATURE (463)..(463): Xaa is Thr or Ile
  MISC_FEATURE (464)..(464): Xaa is Leu or Ile
  MISC_FEATURE (465)..(465): Xaa is Gly or Ala
  MISC_FEATURE (466)..(466): Xaa is Lys, Asn, or Arg
  MISC_FEATURE (467)..(467): Xaa is Asp, Asn, or Ser
  MISC_FEATURE (468)..(468): Xaa is Ala, Ser, or absent
  MISC_FEATURE (469)..(469): Xaa is Thr or absent
  MISC_FEATURE (470)..(470): Xaa is Trp or absent
  MISC_FEATURE (471)..(471): Xaa is Gly or absent
  MISC_FEATURE (472)..(472): Xaa is Tyr or absent
  MISC_FEATURE (473)..(473): Xaa is Arg or absent
  MISC_FEATURE (474)..(474): Xaa is Gln, Arg, Glu, or absent
  MISC_FEATURE (475)..(475): Xaa is Gly or absent
  MISC_FEATURE (476)..(476): Xaa is Pro, Gln, Glu, or absent
  MISC_FEATURE (477)..(477): Xaa is Tyr or Ser
  MISC_FEATURE (479)..(479): Xaa is Asn or Asp
  MISC_FEATURE (480)..(480): Xaa is Thr or absent
  MISC_FEATURE (481)..(481): Xaa is Asn or absent
  MISC_FEATURE (482)..(482): Xaa is Val or absent
  MISC_FEATURE (483)..(483): Xaa is Thr, Leu, or absent
  MISC_FEATURE (484)..(484): Xaa is Asn or absent
  MISC_FEATURE (485)..(485): Xaa is Ala or absent
  MISC_FEATURE (486)..(486): Xaa is Leu, Thr, Val, or absent
  MISC_FEATURE (487)..(487): Xaa is Lys, Glu, Ala, or absent
  MISC_FEATURE (489)..(489): Xaa is Met or Phe
  MISC_FEATURE (491)..(491): Xaa is Ser or Asn
  MISC_FEATURE (492)..(492): Xaa is Ser or absent
  MISC_FEATURE (493)..(493): Xaa is Arg, Ser, Ala, Thr, Lys, or absent
  MISC_FEATURE (494)..(494): Xaa is Arg or absent
  MISC_FEATURE (495)..(495): Xaa is Tyr or absent
  MISC_FEATURE (496)..(496): Xaa is Pro or absent
  MISC_FEATURE (497)..(497): Xaa is Ile, Arg, Val, or absent
  MISC_FEATURE (498)..(498): Xaa is Pro, Asn, or Gly
  MISC_FEATURE (499)..(499): Xaa is Gln, Arg, Lys, or absent
  MISC_FEATURE (500)..(500): Xaa is Gly, His, or absent
  MISC_FEATURE (501)..(501): Xaa is Asn, Asp, Glu, Ser, or absent
  MISC_FEATURE (502)..(502): Xaa is Gln, Asn, Glu, or absent
  MISC_FEATURE (503)..(503): Xaa is Val, Ala, or Ile
  MISC_FEATURE (505)..(505): Xaa is Asn or Leu
  MISC_FEATURE (506)..(506): Xaa is Cys or Gln
  MISC_FEATURE (507)..(507): Xaa is Ser, Met, Thr, or Asn
  MISC_FEATURE (508)..(508): Xaa is Phe, Ile, Val, or absent
  MISC_FEATURE (509)..(509): Xaa is Gly, Thr, Ser, or absent
  MISC_FEATURE (510)..(510): Xaa is Tyr or absent
  MISC_FEATURE (511)..(511): Xaa is Thr or absent
  MISC_FEATURE (512)..(512): Xaa is Cys or absent
  MISC_FEATURE (513)..(513): Xaa is Leu, Ile, or absent
  MISC_FEATURE (514)..(514): Xaa is Lys, Gln, or absent
  MISC_FEATURE (515)..(515): Xaa is Gly or absent
  MISC_FEATURE (516)..(516): Xaa is Asn, Asp, or absent
  MISC_FEATURE (517)..(517): Xaa is Leu, Val, Phe, or absent
  MISC_FEATURE (518)..(518): Xaa is Ser, Ala, or absent
  MISC_FEATURE (519)..(519): Xaa is Trp, Met, or His
  MISC_FEATURE (520)..(520): Xaa is Pro or Trp
  MISC_FEATURE (521)..(521): Xaa is Val or Ile
  MISC_FEATURE (522)..(522): Xaa is Pro or Phe
  MISC_FEATURE (523)..(523): Xaa is Phe, Leu, or Tyr
  MISC_FEATURE (524)..(524): Xaa is Lys, Arg, or Gln
  MISC_FEATURE (525)..(525): Xaa is Ile or Val
  MISC_FEATURE (526)..(526): Xaa is His, Thr, or Gln
  MISC_FEATURE (527)..(527): Xaa is Phe, Leu, or Tyr
  MISC_FEATURE (528)..(528): Xaa is Asn or Ala
  MISC_FEATURE (529)..(529): Xaa is His, Ser, or Tyr
  MISC_FEATURE (530)..(530): Xaa is Gly, Val, Cys, or Ala
  MISC_FEATURE (531)..(531): Xaa is Pro, Leu, Arg, Thr, or Phe
  MISC_FEATURE (532)..(532): Xaa is Glu, Thr, or Lys
  MISC_FEATURE (533)..(533): Xaa is Gly or Ala
  MISC_FEATURE (534)..(534): Xaa is Lys, Tyr, or Phe
  MISC_FEATURE (535)..(535): Xaa is Ser or Val
  MISC_FEATURE (536)..(536): Xaa is Phe, Leu, or absent
  MISC_FEATURE (537)..(537): Xaa is Lys or absent
  MISC_FEATURE (538)..(538): Xaa is Phe or absent
  MISC_FEATURE (539)..(539): Xaa is Ile, Thr, or absent
  MISC_FEATURE (540)..(540): Xaa is Trp or absent
  MISC_FEATURE (541)..(541): Xaa is Gln, Arg, or absent
  MISC_FEATURE (542)..(542): Xaa is Thr, Val, Ala, or absent
  MISC_FEATURE (543)..(543): Xaa is Val or absent
  MISC_FEATURE (544)..(544): Xaa is Ser, Asn, Ala, Gln, or absent
  MISC_FEATURE (545)..(545): Xaa is Asn, Arg, or absent
  MISC_FEATURE (546)..(546): Xaa is Gln or absent
  MISC_FEATURE (547)..(547): Xaa is Lys, Arg, Ala, Pro, or absent
  MISC_FEATURE (548)..(548): Xaa is Phe or absent
  MISC_FEATURE (549)..(549): Xaa is Asp or absent
  MISC_FEATURE (550)..(550): Xaa is Ile or absent
  MISC_FEATURE (551)..(551): Xaa is Pro or absent
  MISC_FEATURE (552)..(552): Xaa is Cys or absent
  MISC_FEATURE (553)..(553): Xaa is Cys or absent
  MISC_FEATURE (554)..(554): Xaa is Ser, Phe, or absent
  MISC_FEATURE (555)..(555): Xaa is Phe or absent
  MISC_FEATURE (556)..(556): Xaa is Ser or absent
  MISC_FEATURE (557)..(557): Xaa is Tyr or absent
  MISC_FEATURE (558)..(558): Xaa is Ile or absent
  MISC_FEATURE (559)..(559): Xaa is Thr or absent
  MISC_FEATURE (560)..(560): Xaa is Glu or absent
  MISC_FEATURE (561)..(561): Xaa is Glu, Gln, or absent
MKRXRXXEDFNPVYPYDXPXAPXMPFITPPFTSSDGLQEKPXGVLSXNYXXPXTTQNGSLTXKXGXGLXXXXQGXLTSTXXXVXPPLTNXXXXLXLXYSXPLXVXXXXXXXSXXAPXXXXXXSLXLXXXXPXFIXXXXXLALXTXAPLXXXXGXLRLQSAAPLGXXXXTLXLLFXXPLXLQXXFLXLXIERPLAXXXXGXLXXXLXPPXXXXXXGLXXXXXXPXTXXNGXLXXXXXRPXXXXXXXLXXXXXXPLRLFXSXPXLGXXFXXPXXVXXXXLXXXXGXGLXXXXXXLTXNXGXDLXXXNXXXXVXLXXXXPLQYTXXLXLNXGAGLXXXXXXXXLXXXXXXXXGLTWXXXXXXXXLGXGLXFXXXGXXXXXXXXXXXXTLWTTADPSPNCXXYXXLDAXXWLXLVKXGXXVXGSXALXAXKXXLXXXTXXXXXIXXXFXXXGVXXXXYPTXXXXXGXXXXXXXXXXXXXXXAXXXXXXXXXFXPXXXXXXXXXXXXXQXXXXXXXXXXXXXXXXXXXXXXXXXXXXXXXXXXXXXXXXXXXXXXXXXXXXXXXXX

SEQ ID NO: 265 - protein, 315 aa, Artificial Sequence
  Seq_265 is a consensus majority sequence of SEQ ID NOs: 121, 124, 127, 129, 131, 138, 140, and 142
  MISC_FEATURE (1)..(1): Xaa is Met or absent
  MISC_FEATURE (2)..(2): Xaa is Arg or absent
  MISC_FEATURE (3)..(3): Xaa is Trp or absent
  MISC_FEATURE (4)..(4): Xaa is Trp or absent
  MISC_FEATURE (5)..(5): Xaa is Ala or absent
  MISC_FEATURE (6)..(6): Xaa is Ala or absent
  MISC_FEATURE (7)..(7): Xaa is Asn or absent
  MISC_FEATURE (8)..(8): Xaa is Phe or absent
  MISC_FEATURE (9)..(9): Xaa is Leu or absent
  MISC_FEATURE (10)..(10): Xaa is Gln or absent
  MISC_FEATURE (11)..(11): Xaa is Thr or absent
  MISC_FEATURE (12)..(12): Xaa is Leu or absent
  MISC_FEATURE (13)..(13): Xaa is Met, Lys, or absent
  MISC_FEATURE (14)..(14): Xaa is Tyr, Glu, or absent
  MISC_FEATURE (15)..(15): Xaa is Leu, Ile, or absent
  MISC_FEATURE (16)..(16): Xaa is Leu, or absent
  MISC_FEATURE (17)..(17): Xaa is Met, Ile, or Leu
  MISC_FEATURE (18)..(18): Xaa is Ser or Thr
  MISC_FEATURE (20)..(20): Xaa is Ser or absent
  MISC_FEATURE (21)..(21): Xaa is Leu or absent
  MISC_FEATURE (22)..(22): Xaa is Pro, Leu, or absent
  MISC_FEATURE (23)..(23): Xaa is Leu, Phe, or absent
  MISC_FEATURE (24)..(24): Xaa is Pro or absent
  MISC_FEATURE (25)..(25): Xaa is Thr or His
  MISC_FEATURE (26)..(26): Xaa is Ile or Asp
  MISC_FEATURE (28)..(28): Xaa is Ile or His
  MISC_FEATURE (29)..(29): Xaa is Phe or Leu
  MISC_FEATURE (31)..(31): Xaa is Glu or Gln
  MISC_FEATURE (48)..(48): Xaa is Asp or Asn
  MISC_FEATURE (49)..(49): Xaa is Thr or Ala
  MISC_FEATURE (50)..(50): Xaa is Glu, or Thr
  MISC_FEATURE (51)..(51): Xaa is Ser, Gln, or Pro
  MISC_FEATURE (52)..(52): Xaa is Thr or Ser
  MISC_FEATURE (53)..(53): Xaa is Pro or Ser
  MISC_FEATURE (54)..(54): Xaa is Ser or Ala
  MISC_FEATURE (55)..(55): Xaa is Ile, Val, or Ala
  MISC_FEATURE (58)..(58): Xaa is Val, or Ile
  MISC_FEATURE (59)..(59): Xaa is Thr, or Ser
  MISC_FEATURE (63)..(63): Xaa is Val or Thr
  MISC_FEATURE (64)..(64): Xaa is Ser, or Asn
  MISC_FEATURE (66)..(66): Xaa is Asn, or Asp
  MISC_FEATURE (68)..(68): Xaa is Leu, or Phe
  MISC_FEATURE (69)..(69): Xaa is Gln, Thr, or Met
  MISC_FEATURE (73)..(73): Xaa is Ser or Pro
  MISC_FEATURE (75)..(75): Xaa is Val or Ile
  MISC_FEATURE (77)..(77): Xaa is Ser or Thr
  MISC_FEATURE (78)..(78): Xaa is Leu or Ile
  MISC_FEATURE (79)..(79): Xaa is Arg or Asn
  MISC_FEATURE (80)..(80): Xaa is Tyr or Leu
  MISC_FEATURE (81)..(81): Xaa is Asn, Ser, or Thr
  MISC_FEATURE (82)..(82): Xaa is Gln or Lys
  MISC_FEATURE (84)..(84): Xaa is Leu or Ile
  MISC_FEATURE (85)..(85): Xaa is Thr or Ser
  MISC_FEATURE (86)..(86): Xaa is Phe, Thr, or Val
  MISC_FEATURE (87)..(87): Xaa is Thr, Ile, or Val
  MISC_FEATURE (89)..(89): Xaa is His, Gly, or Asn
  MISC_FEATURE (90)..(90): Xaa is Ala, Lys, or Ser
  MISC_FEATURE (91)..(91): Xaa is Leu or Val
  MISC_FEATURE (92)..(92): Xaa is Ser or Thr
  MISC_FEATURE (94)..(94): Xaa is Asn or Lys
  MISC_FEATURE (95)..(95): Xaa is Val or Thr
  MISC_FEATURE (96)..(96): Xaa is Gly or Asp
  MISC_FEATURE (97)..(97): Xaa is Ser, Gly, or Asn
  MISC_FEATURE (100)..(100): Xaa is Thr, Asn, or Ser
  MISC_FEATURE (101)..(101): Xaa is Ile or Val
  MISC_FEATURE (102)..(102): Xaa is Asn or Ser
  MISC_FEATURE (103)..(103): Xaa is Ser or Asn
  MISC_FEATURE (104)..(104): Xaa is Asp or Thr
  MISC_FEATURE (105)..(105): Xaa is Gly or Lys
  MISC_FEATURE (106)..(106): Xaa is Lys or Phe
  MISC_FEATURE (108)..(108): Xaa is Gln or Glu
  MISC_FEATURE (109)..(109): Xaa is Ala, Val, or Ile
  MISC_FEATURE (110)..(110): Xaa is Thr, Arg, or Ala
  MISC_FEATURE (111)..(111): Xaa is Gln, Thr, or Ile
  MISC_FEATURE (112)..(112): Xaa is Asn or Gln
  MISC_FEATURE (113)..(113): Xaa is Ile, Glu, or Thr
  MISC_FEATURE (114)..(114): Xaa is Asn or Ser
  MISC_FEATURE (115)..(115): Xaa is Glu, Thr, Lys, or Ala
  MISC_FEATURE (116)..(116): Xaa is Gly or Ala
  MISC_FEATURE (117)..(117): Xaa is Asn or absent
  MISC_FEATURE (118)..(118): Xaa is Pro or absent
  MISC_FEATURE (119)..(119): Xaa is Leu or Val
  MISC_FEATURE (120)..(120): Xaa is Leu, Thr, or Ser
  MISC_FEATURE (121)..(121): Xaa is Leu or Asn
  MISC_FEATURE (122)..(122): Xaa is Gln or Glu
  MISC_FEATURE (123)..(123): Xaa is Asn or Asp
  MISC_FEATURE (125)..(125): Xaa is Thr, Ala, or Lys
  MISC_FEATURE (126)..(126): Xaa is Leu, Val, or Ile
  MISC_FEATURE (127)..(127): Xaa is Ser or Ala
  MISC_FEATURE (128)..(128): Xaa is Val or Leu
  MISC_FEATURE (129)..(129): Xaa is Lys or Ile
  MISC_FEATURE (130)..(130): Xaa is Ser, Ile, or Val
  MISC_FEATURE (131)..(131): Xaa is Gly or Ser
  MISC_FEATURE (132)..(132): Xaa is Ala, Asn, or Pro
  MISC_FEATURE (133)..(133): Xaa is Pro, Asp, or Glu
  MISC_FEATURE (135)..(135): Xaa is Tyr or Arg
  MISC_FEATURE (136)..(136): Xaa is Phe or Val
  MISC_FEATURE (137)..(137): Xaa is Asp or Asn
  MISC_FEATURE (138)..(138): Xaa is Gly, Ser, or Ala
  MISC_FEATURE (139)..(139): Xaa is Arg, Asp, or absent
  MISC_FEATURE (140)..(140): Xaa is Gly or Ser
  MISC_FEATURE (141)..(141): Xaa is Ala or Gln
  MISC_FEATURE (142)..(142): Xaa is Ile or Leu
  MISC_FEATURE (143)..(143): Xaa is Thr or Ala
  MISC_FEATURE (144)..(144): Xaa is Leu or Met
  MISC_FEATURE (145)..(145): Xaa is Asn or Arg
  MISC_FEATURE (146)..(146): Xaa is Leu, Pro, or Ser
  MISC_FEATURE (147)..(147): Xaa is Asn, Val, or Gln
  MISC_FEATURE (148)..(148): Xaa is Ser or Thr
  MISC_FEATURE (149)..(149): Xaa is Leu or Pro
  MISC_FEATURE (150)..(150): Xaa is Trp or Phe
  MISC_FEATURE (151)..(151): Xaa is Thr or Val
  MISC_FEATURE (152)..(152): Xaa is Val, Thr, or Asn
  MISC_FEATURE (153)..(153): Xaa is Pro or His
  MISC_FEATURE (154)..(154): Xaa is Asn or Ser
  MISC_FEATURE (155)..(155): Xaa is Glu or Asn
  MISC_FEATURE (156)..(156): Xaa is Gly, Ser, or Thr
  MISC_FEATURE (157)..(157): Xaa is Ala or Leu
  MISC_FEATURE (158)..(158): Xaa is Asn or Ala
  MISC_FEATURE (159)..(159): Xaa is Cys or Ile
  MISC_FEATURE (160)..(160): Xaa is Asn, Thr, or Ser
  MISC_FEATURE (161)..(161): Xaa is Leu or Val
  MISC_FEATURE (162)..(162): Xaa is Ala, Tyr, or Phe
  MISC_FEATURE (163)..(163): Xaa is Glu, Asn, or Gln
  MISC_FEATURE (164)..(164): Xaa is Ser or Pro
  MISC_FEATURE (165)..(165): Xaa is Ser, Leu, or absent
  MISC_FEATURE (166)..(166): Xaa is Ala, Asp, or absent
  MISC_FEATURE (167)..(167): Xaa is Asn, Ser, or absent
  MISC_FEATURE (168)..(168): Xaa is Phe, Leu, or absent
  MISC_FEATURE (169)..(169): Xaa is Phe, Leu, or absent
  MISC_FEATURE (170)..(170): Xaa is Thr or absent
  MISC_FEATURE (172)..(172): Xaa is Cys or Tyr
  MISC_FEATURE (173)..(173): Xaa is Leu or Val
  MISC_FEATURE (175)..(175): Xaa is Asn, Arg, or Lys
  MISC_FEATURE (177)..(177): Xaa is Ser, Asp, or Gly
  MISC_FEATURE (178)..(178): Xaa is Ala or Leu
  MISC_FEATURE (179)..(179): Xaa is His or Asn
  MISC_FEATURE (180)..(180): Xaa is Val or Leu
  MISC_FEATURE (181)..(181): Xaa is Arg, Val, or Leu
  MISC_FEATURE (182)..(182): Xaa is Gly or absent
  MISC_FEATURE (183)..(183): Xaa is Thr, Ser, or absent
  MISC_FEATURE (184)..(184): Xaa is Val or absent
  MISC_FEATURE (185)..(185): Xaa is Asn, Ser, or absent
  MISC_FEATURE (186)..(186): Xaa is Leu or absent
  MISC_FEATURE (187)..(187): Xaa is Thr or absent
  MISC_FEATURE (188)..(188): Xaa is Gly or absent
  MISC_FEATURE (189)..(189): Xaa is Leu or Ile
  MISC_FEATURE (190)..(190): Xaa is Ala, Asn, or Ser
  MISC_FEATURE (191)..(191): Xaa is Gly or Ser
  MISC_FEATURE (192)..(192): Xaa is Pro or Lys
  MISC_FEATURE (193)..(193): Xaa is Phe or Leu
  MISC_FEATURE (194)..(194): Xaa is Tyr, Ser, or Leu
  MISC_FEATURE (195)..(195): Xaa is Ser, Lys, or absent
  MISC_FEATURE (196)..(196): Xaa is Met or Val
  MISC_FEATURE (197)..(197): Xaa is Thr or Asn
  MISC_FEATURE (198)..(198): Xaa is Asn, Glu, or Thr
  MISC_FEATURE (199)..(199): Xaa is Asn or Thr
  MISC_FEATURE (201)..(201): Xaa is Val or Leu
  MISC_FEATURE (202)..(202): Xaa is Asn, Ile , or Thr
  MISC_FEATURE (203)..(203): Xaa is Val or Leu
  MISC_FEATURE (204)..(204): Xaa is Gln or Arg
  MISC_FEATURE (206)..(206): Xaa is Pro, Ala, or Ile
  MISC_FEATURE (207)..(207): Xaa is Phe or Asn
  MISC_FEATURE (208)..(208): Xaa is Asp or Pro
  MISC_FEATURE (209)..(209): Xaa is Ser or Glu
  MISC_FEATURE (210)..(210): Xaa is Asn or Gly
  MISC_FEATURE (211)..(211): Xaa is Gly or Leu
  MISC_FEATURE (212)..(212): Xaa is Ser, Thr, or Val
  MISC_FEATURE (213)..(213): Xaa is Leu or Ile
  MISC_FEATURE (214)..(214): Xaa is Asp, Gln, or Thr
  MISC_FEATURE (215)..(215): Xaa is Gly, Ser, or Thr
  MISC_FEATURE (217)..(217): Xaa is Gly, Pro, or Gln
  MISC_FEATURE (219)..(219): Xaa is Lys, Ala, or Asn
  MISC_FEATURE (220)..(220): Xaa is Val, Gln, or Thr
  MISC_FEATURE (221)..(221): Xaa is Asn or Lys
  MISC_FEATURE (222)..(222): Xaa is Ala, Val, or Ser
  MISC_FEATURE (223)..(223): Xaa is Gly or absent
  MISC_FEATURE (224)..(224): Xaa is Trp or Tyr
  MISC_FEATURE (225)..(225): Xaa is Gly or Ala
  MISC_FEATURE (226)..(226): Xaa is Leu, Ile, Met, or Tyr
  MISC_FEATURE (227)..(227): Xaa is Arg or absent
  MISC_FEATURE (228)..(228): Xaa is Leu, Gln, Ala, or absent
  MISC_FEATURE (229)..(229): Xaa is His, Thr, Asn, or absent
  MISC_FEATURE (230)..(230): Xaa is Ala, Pro, Thr, or absent
  MISC_FEATURE (231)..(231): Xaa is Asn or absent
  MISC_FEATURE (232)..(232): Xaa is Ser, Leu, or absent
  MISC_FEATURE (233)..(233): Xaa is Asn or absent
  MISC_FEATURE (234)..(234): Xaa is Pro, Ala, or absent
  MISC_FEATURE (235)..(235): Xaa is Asn, Pro, or absent
  MISC_FEATURE (236)..(236): Xaa is Asp, Ala, Val, or absent
  MISC_FEATURE (237)..(237): Xaa is Leu, Val, or Thr
  MISC_FEATURE (238)..(238): Xaa is Tyr, Asn, or Lys
  MISC_FEATURE (239)..(239): Xaa is Val, Leu, or Ala
  MISC_FEATURE (240)..(240): Xaa is Leu or Tyr
  MISC_FEATURE (241)..(241): Xaa is Thr or Pro
  MISC_FEATURE (242)..(242): Xaa is Asp, Phe, or Leu
  MISC_FEATURE (243)..(243): Xaa is Phe, Met, or Gln
  MISC_FEATURE (244)..(244): Xaa is Pro or absent
  MISC_FEATURE (245)..(245): Xaa is Ser, Asn, or absent
  MISC_FEATURE (246)..(246): Xaa is Ser or absent
  MISC_FEATURE (247)..(247): Xaa is Leu, Thr, or absent
  MISC_FEATURE (248)..(248): Xaa is Val, Ile, or absent
  MISC_FEATURE (249)..(249): Xaa is Leu, Tyr, or absent
  MISC_FEATURE (250)..(250): Xaa is Asp, Pro, Ala, or absent
  MISC_FEATURE (251)..(251): Xaa is Lys, Arg, or absent
  MISC_FEATURE (252)..(252): Xaa is Tyr, Glu, Gly, or absent
  MISC_FEATURE (253)..(253): Xaa is Asp, Gly, Asn, or absent
  MISC_FEATURE (254)..(254): Xaa is Asn, Gly, Ala, or absent
  MISC_FEATURE (255)..(255): Xaa is Gly or absent
  MISC_FEATURE (256)..(256): Xaa is Ala, Lys, Glu, or absent
  MISC_FEATURE (257)..(257): Xaa is Lys, Pro, or absent
  MISC_FEATURE (258)..(258): Xaa is Gln, Lys, Arg, or absent
  MISC_FEATURE (259)..(259): Xaa is Gly, Asn, Ser, or absent
  MISC_FEATURE (260)..(260): Xaa is Gln, Asn, or absent
  MISC_FEATURE (261)..(261): Xaa is Leu, Tyr, or absent
  MISC_FEATURE (262)..(262): Xaa is Tyr or absent
  MISC_FEATURE (263)..(263): Xaa is Leu, Phe, Val, or absent
  MISC_FEATURE (264)..(264): Xaa is Arg, Asn, Gln, or absent
  MISC_FEATURE (265)..(265): Xaa is Thr or absent
  MISC_FEATURE (266)..(266): Xaa is Gly, Phe, Tyr, or absent
  MISC_FEATURE (267)..(267): Xaa is Leu or absent
  MISC_FEATURE (268)..(268): Xaa is Lys, Arg, or absent
  MISC_FEATURE (269)..(269): Xaa is Gly or absent
  MISC_FEATURE (270)..(270): Xaa is Asn or absent
  MISC_FEATURE (271)..(271): Xaa is Leu or absent
  MISC_FEATURE (272)..(272): Xaa is Ser, Asn, or absent
  MISC_FEATURE (273)..(273): Xaa is Arg, Lys, or absent
  MISC_FEATURE (274)..(274): Xaa is Pro, Gln, or absent
  MISC_FEATURE (275)..(275): Xaa is Ile or absent
  MISC_FEATURE (276)..(276): Xaa is Thr or absent
  MISC_FEATURE (278)..(278): Xaa is Gln, Thr, Ser, or Leu
  MISC_FEATURE (279)..(279): Xaa is Leu or Ile
  MISC_FEATURE (280)..(280): Xaa is Ser, Thr, or Cys
  MISC_FEATURE (281)..(281): Xaa is Asn, Leu, or Phe
  MISC_FEATURE (282)..(282): Xaa is Asn or His
  MISC_FEATURE (283)..(283): Xaa is Asp, Ser, Ala, or Leu
  MISC_FEATURE (284)..(284): Xaa is Leu, Ser, or Cys
  MISC_FEATURE (285)..(285): Xaa is Thr, Pro, or Ser
  MISC_FEATURE (286)..(286): Xaa is Val, Thr, Ser, or Ala
  MISC_FEATURE (287)..(287): Xaa is Lys, Gly, or Ala
  MISC_FEATURE (288)..(288): Xaa is Leu, Tyr, or absent
  MISC_FEATURE (289)..(289): Xaa is Gly, Thr, Ser, or absent
  MISC_FEATURE (290)..(290): Xaa is Ala, Leu, or absent
  MISC_FEATURE (291)..(291): Xaa is Gly, Thr, or absent
  MISC_FEATURE (292)..(292): Xaa is Leu, Phe, or absent
  MISC_FEATURE (293)..(293): Xaa is Lys or absent
  MISC_FEATURE (294)..(294): Xaa is Phe, Trp, or absent
  MISC_FEATURE (295)..(295): Xaa is Asp, Gly, Ser, or absent
  MISC_FEATURE (296)..(296): Xaa is Asn, Thr, Ala, or absent
  MISC_FEATURE (297)..(297): Xaa is Asn, Tyr, Ile, or absent
  MISC_FEATURE (298)..(298): Xaa is Gly, Leu, Ala, or absent
  MISC_FEATURE (299)..(299): Xaa is Ala, Asn, Thr, or absent
  MISC_FEATURE (300)..(300): Xaa is Ile, Glu, or absent
  MISC_FEATURE (301)..(301): Xaa is Thr, Pro, Lys, or absent
  MISC_FEATURE (302)..(302): Xaa is Leu, Phe, or absent
  MISC_FEATURE (303)..(303): Xaa is Ala, Ser, or absent
  MISC_FEATURE (304)..(304): Xaa is Ser, Val, Thr, or absent
  MISC_FEATURE (305)..(305): Xaa is Thr, Pro, or absent
  MISC_FEATURE (306)..(306): Xaa is Thr or absent
  MISC_FEATURE (307)..(307): Xaa is Thr, Ser, or absent
  MISC_FEATURE (308)..(308): Xaa is Cys, Ser, or absent
  MISC_FEATURE (309)..(309): Xaa is Phe or absent
  MISC_FEATURE (310)..(310): Xaa is Cys or absent
  MISC_FEATURE (311)..(311): Xaa is Tyr or absent
  MISC_FEATURE (312)..(312): Xaa is Val, Ile, or absent
  MISC_FEATURE (313)..(313): Xaa is Ala or absent
  MISC_FEATURE (314)..(314): Xaa is Glu or absent
  MISC_FEATURE (315)..(315): Xaa is Gln or absent
XXXXXXXXXXXXXXXXXXTXXXXXXXFXXSXMKRTRVDEDFNPVYPYXXXXXXXXPFXXPPFXXSXGXXESPXGXLXXXXXXPXXXXNXXXXLXXXXGLXXXXXXXLXXXXXXXXXXXXXXXXNXXXXXXXXXLXXXXXXXXXXXXXXXXXXXXXXXXXXXXXXXXXXXXLXXTXNXXXXXXXXXXXXXXXXXXXXXXXSXXXXLXXXXXXXXXXSXLXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXX

SEQ ID NO: 266 - protein, 363 aa, Artificial Sequence
  Seq_266 is a consensus majority sequence of SEQ ID NOs: 122, 125, 128, 130, 132, 135, 137, 139, 141, and 143
  MISC_FEATURE (4)..(4): Xaa is Ala or Thr
  MISC_FEATURE (6)..(6): Xaa is Val or Ile
  MISC_FEATURE (7)..(7): Xaa is Asp or Glu
  MISC_FEATURE (8)..(8): Xaa is Glu or Asp
  MISC_FEATURE (9)..(9): Xaa is Ser or Asp
  MISC_FEATURE (10)..(10): Xaa is Phe or Tyr
  MISC_FEATURE (17)..(17): Xaa is Asp or Asn
  MISC_FEATURE (18)..(18): Xaa is Ser or Thr
  MISC_FEATURE (19)..(19): Xaa is Thr, Ser, or Val
  MISC_FEATURE (20)..(20): Xaa is Ser or Thr
  MISC_FEATURE (21)..(21): Xaa is Thr, Pro, or Ala
  MISC_FEATURE (22)..(22): Xaa is Pro or absent
  MISC_FEATURE (23)..(23): Xaa is Ala or absent
  MISC_FEATURE (24)..(24): Xaa is Ile or absent
  MISC_FEATURE (27)..(27): Xaa is Val or Ile
  MISC_FEATURE (28)..(28): Xaa is Thr, Ala, or Ser
  MISC_FEATURE (33)..(33): Xaa is Ser, Asp, or Asn
  MISC_FEATURE (34)..(34): Xaa is Asn or Ser
  MISC_FEATURE (37)..(37): Xaa is Leu or Phe
  MISC_FEATURE (38)..(38): Xaa is Gln or Lys
  MISC_FEATURE (40)..(40): Xaa is Asn or Ser
  MISC_FEATURE (42)..(42): Xaa is Pro or Gln
  MISC_FEATURE (44)..(44): Xaa is Ile or Val
  MISC_FEATURE (48)..(48): Xaa is Gln or Arg
  MISC_FEATURE (50)..(50): Xaa is Ala or Ser
  MISC_FEATURE (54)..(54): Xaa is Phe, Tyr, or Leu
  MISC_FEATURE (56)..(56): Xaa is Asn or Asp
  MISC_FEATURE (57)..(57): Xaa is Thr, Met, Ala, or Ile
  MISC_FEATURE (58)..(58): Xaa is Gln or Asn
  MISC_FEATURE (59)..(59): Xaa is Arg or Lys
  MISC_FEATURE (60)..(60): Xaa is Lys or Arg
  MISC_FEATURE (61)..(61): Xaa is Ile, Leu, or Val
  MISC_FEATURE (62)..(62): Xaa is Ala, Ser, or Thr
  MISC_FEATURE (67)..(67): Xaa is Arg or Gln
  MISC_FEATURE (70)..(70): Xaa is Ala or Ser
  MISC_FEATURE (71)..(71): Xaa is Ile, Thr, or Val
  MISC_FEATURE (72)..(72): Xaa is Thr or Asn
  MISC_FEATURE (76)..(76): Xaa is Glu or Gln
  MISC_FEATURE (79)..(79): Xaa is Asn or Ser
  MISC_FEATURE (80)..(80): Xaa is Thr or Ala
  MISC_FEATURE (82)..(82): Xaa is Arg, Asn, or Ile
  MISC_FEATURE (83)..(83): Xaa is Ile, Val, or Leu
  MISC_FEATURE (84)..(84): Xaa is Gln or Arg
  MISC_FEATURE (85)..(85): Xaa is Ser, Ala, or Thr
  MISC_FEATURE (86)..(86): Xaa is Thr or Asn
  MISC_FEATURE (90)..(90): Xaa is Leu or Ser
  MISC_FEATURE (91)..(91): Xaa is Leu or Ile
  MISC_FEATURE (92)..(92): Xaa is Asn or Ser
  MISC_FEATURE (93)..(93): Xaa is Ser or Asn
  MISC_FEATURE (95)..(95): Xaa is Thr or Met
  MISC_FEATURE (96)..(96): Xaa is Leu or Val
  MISC_FEATURE (98)..(98): Xaa is Met or Leu
  MISC_FEATURE (99)..(99): Xaa is Asn, Arg, or Asp
  MISC_FEATURE (100)..(100): Xaa is Tyr or Cys
  MISC_FEATURE (101)..(101): Xaa is Ser or Ala
  MISC_FEATURE (102)..(102): Xaa is Ser or Phe
  MISC_FEATURE (105)..(105): Xaa is Thr, Asn, or Ser
  MISC_FEATURE (106)..(106): Xaa is Val or Leu
  MISC_FEATURE (107)..(107): Xaa is Leu, Thr, or Ala
  MISC_FEATURE (108)..(108): Xaa is Asp, Glu, or Asn
  MISC_FEATURE (110)..(110): Xaa is Lys, Gly, or Gln
  MISC_FEATURE (112)..(112): Xaa is Ala, Val, or Ser
  MISC_FEATURE (114)..(114): Xaa is Asn, Gly, or Lys
  MISC_FEATURE (116)..(116): Xaa is Leu, Ser, or Thr
  MISC_FEATURE (117)..(117): Xaa is Ser or Asp
  MISC_FEATURE (121)..(121): Xaa is Val or Leu
  MISC_FEATURE (123)..(123): Xaa is Asn or Gly
  MISC_FEATURE (124)..(124): Xaa is Asp or Gly
  MISC_FEATURE (125)..(125): Xaa is Ser or Ala
  MISC_FEATURE (130)..(130): Xaa is Phe or Tyr
  MISC_FEATURE (135)..(135): Xaa is His or Arg
  MISC_FEATURE (136)..(136): Xaa is Val, Tyr, or Leu
  MISC_FEATURE (137)..(137): Xaa is Ala or Glu
  MISC_FEATURE (138)..(138): Xaa is Asp or Asn
  MISC_FEATURE (139)..(139): Xaa is Gly or Asp
  MISC_FEATURE (140)..(140): Xaa is Asn or Ser
  MISC_FEATURE (144)..(144): Xaa is Ser or Asn
  MISC_FEATURE (147)..(147): Xaa is Ser or Thr
  MISC_FEATURE (150)..(150): Xaa is Gln, His, Lys, or Asn
  MISC_FEATURE (151)..(151): Xaa is Val, Leu, or Ile
  MISC_FEATURE (152)..(152): Xaa is Thr, Met, or Ile
  MISC_FEATURE (158)..(158): Xaa is Leu or Ile
  MISC_FEATURE (159)..(159): Xaa is Asn or Glu
  MISC_FEATURE (160)..(160): Xaa is Tyr or Val
  MISC_FEATURE (161)..(161): Xaa is Ser or Asn
  MISC_FEATURE (162)..(162): Xaa is Ala, Ser, or Pro
  MISC_FEATURE (163)..(163): Xaa is Pro or Ser
  MISC_FEATURE (164)..(164): Xaa is Lys or absent
  MISC_FEATURE (165)..(165): Xaa is Gly or absent
  MISC_FEATURE (166)..(166): Xaa is Val or absent
  MISC_FEATURE (167)..(167): Xaa is Thr or absent
  MISC_FEATURE (168)..(168): Xaa is Ser or absent
  MISC_FEATURE (169)..(169): Xaa is Lys or absent
  MISC_FEATURE (170)..(170): Xaa is Asn or absent
  MISC_FEATURE (171)..(171): Xaa is Gly or absent
  MISC_FEATURE (172)..(172): Xaa is Ala or absent
  MISC_FEATURE (173)..(173): Xaa is Ile or absent
  MISC_FEATURE (174)..(174): Xaa is Ala or absent
  MISC_FEATURE (175)..(175): Xaa is Leu or Val
  MISC_FEATURE (176)..(176): Xaa is Arg or Gln
  MISC_FEATURE (178)..(178): Xaa is Leu, Ser, or Val
  MISC_FEATURE (179)..(179): Xaa is Asn or Pro
  MISC_FEATURE (180)..(180): Xaa is Asn, Asp, or Ser
  MISC_FEATURE (181)..(181): Xaa is Ser, Leu, or Asn
  MISC_FEATURE (182)..(182): Xaa is Lys or absent
  MISC_FEATURE (183)..(183): Xaa is Phe or absent
  MISC_FEATURE (184)..(184): Xaa is Asp or absent
  MISC_FEATURE (185)..(185): Xaa is Ser or absent
  MISC_FEATURE (186)..(186): Xaa is Asn or absent
  MISC_FEATURE (187)..(187): Xaa is Gly or absent
  MISC_FEATURE (188)..(188): Xaa is Ser or absent
  MISC_FEATURE (189)..(189): Xaa is Ile or absent
  MISC_FEATURE (190)..(190): Xaa is Ala or absent
  MISC_FEATURE (191)..(191): Xaa is Phe or absent
  MISC_FEATURE (192)..(192): Xaa is Gly or absent
  MISC_FEATURE (193)..(193): Xaa is Ile or absent
  MISC_FEATURE (194)..(194): Xaa is Gln or absent
  MISC_FEATURE (195)..(195): Xaa is Thr or absent
  MISC_FEATURE (196)..(196): Xaa is Leu or absent
  MISC_FEATURE (197)..(197): Xaa is Trp or absent
  MISC_FEATURE (198)..(198): Xaa is Thr or absent
  MISC_FEATURE (199)..(199): Xaa is Phe or absent
  MISC_FEATURE (200)..(200): Xaa is Pro or absent
  MISC_FEATURE (201)..(201): Xaa is Leu or Thr
  MISC_FEATURE (203)..(203): Xaa is Phe, Thr, or Met
  MISC_FEATURE (204)..(204): Xaa is Thr, Ser, or Gly
  MISC_FEATURE (205)..(205): Xaa is Tyr or Asn
  MISC_FEATURE (206)..(206): Xaa is Ala or Cys
  MISC_FEATURE (207)..(207): Xaa is Asn, Thr, or Asp
  MISC_FEATURE (208)..(208): Xaa is Pro or Val
  MISC_FEATURE (210)..(210): Xaa is Lys, Thr, or Gln
  MISC_FEATURE (211)..(211): Xaa is Ile, Ser, or Val
  MISC_FEATURE (212)..(212): Xaa is Ala or Asn
  MISC_FEATURE (213)..(213): Xaa is Asn or Asp
  MISC_FEATURE (215)..(215): Xaa is Ser or Leu
  MISC_FEATURE (219)..(219): Xaa is Lys or Cys
  MISC_FEATURE (220)..(220): Xaa is Leu or Ile
  MISC_FEATURE (221)..(221): Xaa is Asp, Thr, or Ala
  MISC_FEATURE (222)..(222): Xaa is Tyr, Lys, or Asn
  MISC_FEATURE (223)..(223): Xaa is Pro or Cys
  MISC_FEATURE (224)..(224): Xaa is Ser or Gly
  MISC_FEATURE (225)..(225): Xaa is Ala or Gly
  MISC_FEATURE (226)..(226): Xaa is Leu or His
  MISC_FEATURE (227)..(227): Xaa is Arg or Val
  MISC_FEATURE (228)..(228): Xaa is Leu or Ile
  MISC_FEATURE (229)..(229): Xaa is Asn, Gly, or Arg
  MISC_FEATURE (230)..(230): Xaa is Asn or Ser
  MISC_FEATURE (231)..(231): Xaa is Asn or absent
  MISC_FEATURE (232)..(232): Xaa is Gly or Val
  MISC_FEATURE (233)..(233): Xaa is Ser or Asn
  MISC_FEATURE (235)..(235): Xaa is Gln or Thr
  MISC_FEATURE (236)..(236): Xaa is Val, Gly, or Ile
  MISC_FEATURE (237)..(237): Xaa is Ile, Met, or Ala
  MISC_FEATURE (240)..(240): Xaa is Trp, Ala, or Tyr
  MISC_FEATURE (241)..(241): Xaa is Gly or Leu
  MISC_FEATURE (243)..(243): Xaa is Gly, Asn or Gln
  MISC_FEATURE (244)..(244): Xaa is Ile or Met
  MISC_FEATURE (245)..(245): Xaa is Ala or Thr
  MISC_FEATURE (246)..(246): Xaa is Gly or Gln
  MISC_FEATURE (247)..(247): Xaa is Asn or Thr
  MISC_FEATURE (248)..(248): Xaa is Ser or absent
  MISC_FEATURE (249)..(249): Xaa is Val or absent
  MISC_FEATURE (250)..(250): Xaa is Thr or absent
  MISC_FEATURE (251)..(251): Xaa is Ile or absent
  MISC_FEATURE (252)..(252): Xaa is Asn, Gln, or Glu
  MISC_FEATURE (253)..(253): Xaa is Asp or Phe
  MISC_FEATURE (254)..(254): Xaa is Leu or Thr
  MISC_FEATURE (255)..(255): Xaa is Tyr or Phe
  MISC_FEATURE (256)..(256): Xaa is Val or Asp
  MISC_FEATURE (257)..(257): Xaa is Lys, Asn, or Arg
  MISC_FEATURE (258)..(258): Xaa is Arg or Thr
  MISC_FEATURE (259)..(259): Xaa is Gly or absent
  MISC_FEATURE (260)..(260): Xaa is Ser or absent
  MISC_FEATURE (261)..(261): Xaa is Leu or absent
  MISC_FEATURE (262)..(262): Xaa is Thr or absent
  MISC_FEATURE (263)..(263): Xaa is Gln, Ser, or Glu
  MISC_FEATURE (264)..(264): Xaa is Ala, Ser, or Thr
  MISC_FEATURE (267)..(267): Xaa is Ala, Ile, or Asp
  MISC_FEATURE (268)..(268): Xaa is Val or Asn
  MISC_FEATURE (269)..(269): Xaa is Tyr or Asn
  MISC_FEATURE (270)..(270): Xaa is Glu, Ala, or Thr
  MISC_FEATURE (271)..(271): Xaa is Ser or Trp
  MISC_FEATURE (273)..(273): Xaa is Ser, Ile, or Ala
  MISC_FEATURE (274)..(274): Xaa is Asn, Arg, or Lys
  MISC_FEATURE (275)..(275): Xaa is Ala, Gln, or Glu
  MISC_FEATURE (276)..(276): Xaa is Gly or Asn
  MISC_FEATURE (277)..(277): Xaa is Thr, Asp, or Ile
  MISC_FEATURE (278)..(278): Xaa is Leu or Ser
  MISC_FEATURE (279)..(279): Xaa is Tyr or Ala
  MISC_FEATURE (280)..(280): Xaa is Leu or Ser
  MISC_FEATURE (281)..(281): Xaa is Arg or Pro
  MISC_FEATURE (282)..(282): Xaa is Leu or Asn
  MISC_FEATURE (283)..(283): Xaa is Gly or Pro
  MISC_FEATURE (284)..(284): Xaa is Pro or Thr
  MISC_FEATURE (285)..(285): Xaa is Asn or Phe
  MISC_FEATURE (286)..(286): Xaa is Ser or Asn
  MISC_FEATURE (287)..(287): Xaa is Ala or Gly
  MISC_FEATURE (289)..(289): Xaa is Arg, Thr, or Gln
  MISC_FEATURE (290)..(290): Xaa is Thr, Phe, or Val
  MISC_FEATURE (291)..(291): Xaa is Val, Met, or Leu
  MISC_FEATURE (292)..(292): Xaa is Asn, Pro, or Ser
  MISC_FEATURE (293)..(293): Xaa is Asp or Asn
  MISC_FEATURE (294)..(294): Xaa is Asn or Ser
  MISC_FEATURE (295)..(295): Xaa is Leu or Thr
  MISC_FEATURE (296)..(296): Xaa is Thr, Val, or Ser
  MISC_FEATURE (297)..(297): Xaa is Leu or Tyr
  MISC_FEATURE (298)..(298): Xaa is Asn, Ser, or Lys
  MISC_FEATURE (299)..(299): Xaa is Thr or Arg
  MISC_FEATURE (301)..(301): Xaa is Gly or absent
  MISC_FEATURE (302)..(302): Xaa is Ser or absent
  MISC_FEATURE (303)..(303): Xaa is Gly or absent
  MISC_FEATURE (304)..(304): Xaa is Glu or absent
  MISC_FEATURE (305)..(305): Xaa is Pro or absent
  MISC_FEATURE (306)..(306): Xaa is Arg or absent
  MISC_FEATURE (307)..(307): Xaa is Asn or absent
  MISC_FEATURE (308)..(308): Xaa is Asn or absent
  MISC_FEATURE (309)..(309): Xaa is Tyr or absent
  MISC_FEATURE (310)..(310): Xaa is Tyr or absent
  MISC_FEATURE (311)..(311): Xaa is Thr or absent
  MISC_FEATURE (312)..(312): Xaa is Gln or absent
  MISC_FEATURE (313)..(313): Xaa is Thr or absent
  MISC_FEATURE (314)..(314): Xaa is Tyr or absent
  MISC_FEATURE (315)..(315): Xaa is Leu or absent
  MISC_FEATURE (316)..(316): Xaa is Gln or Arg
  MISC_FEATURE (318)..(318): Xaa is Asn or absent
  MISC_FEATURE (319)..(319): Xaa is Ile or absent
  MISC_FEATURE (320)..(320): Xaa is Arg or absent
  MISC_FEATURE (321)..(321): Xaa is Lys or absent
  MISC_FEATURE (322)..(322): Xaa is Pro or absent
  MISC_FEATURE (323)..(323): Xaa is Ile or absent
  MISC_FEATURE (324)..(324): Xaa is Val or absent
  MISC_FEATURE (326)..(326): Xaa is Gln or Thr
  MISC_FEATURE (327)..(327): Xaa is Ile or Val
  MISC_FEATURE (328)..(328): Xaa is Thr or Leu
  MISC_FEATURE (329)..(329): Xaa is Asn, Tyr, or Ser
  MISC_FEATURE (331)..(331): Xaa is Thr or Ser
  MISC_FEATURE (332)..(332): Xaa is Leu or Ala
  MISC_FEATURE (333)..(333): Xaa is Ser or Asn
  MISC_FEATURE (334)..(334): Xaa is Val or Thr
  MISC_FEATURE (335)..(335): Xaa is Lys or Gly
  MISC_FEATURE (336)..(336): Xaa is Leu or Tyr
  MISC_FEATURE (337)..(337): Xaa is Gly or Ser
  MISC_FEATURE (338)..(338): Xaa is Asn, Leu, or Arg
  MISC_FEATURE (339)..(339): Xaa is Gly or Ser
  MISC_FEATURE (340)..(340): Xaa is Leu or Phe
  MISC_FEATURE (341)..(341): Xaa is Arg or Lys
  MISC_FEATURE (342)..(342): Xaa is Phe or Trp
  MISC_FEATURE (343)..(343): Xaa is Asn or Asp
  MISC_FEATURE (344)..(344): Xaa is Asn, Ala, or Ser
  MISC_FEATURE (345)..(345): Xaa is Thr, Ile, or Ser
  MISC_FEATURE (346)..(346): Xaa is Gly or Ala
  MISC_FEATURE (347)..(347): Xaa is Ala or Thr
  MISC_FEATURE (348)..(348): Xaa is Ile or Glu
  MISC_FEATURE (349)..(349): Xaa is Glu or Lys
  MISC_FEATURE (350)..(350): Xaa is Leu or Phe
  MISC_FEATURE (351)..(351): Xaa is Ala or Ser
  MISC_FEATURE (352)..(352): Xaa is Gln or Thr
  MISC_FEATURE (353)..(353): Xaa is Pro or absent
  MISC_FEATURE (354)..(354): Xaa is Thr or absent
  MISC_FEATURE (355)..(355): Xaa is Ser or absent
  MISC_FEATURE (356)..(356): Xaa is Ser or absent
  MISC_FEATURE (357)..(357): Xaa is Phe or absent
  MISC_FEATURE (358)..(358): Xaa is Cys or absent
  MISC_FEATURE (359)..(359): Xaa is Tyr or absent
  MISC_FEATURE (360)..(360): Xaa is Ile or absent
  MISC_FEATURE (361)..(361): Xaa is Ser or absent
  MISC_FEATURE (362)..(362): Xaa is Glu or absent
  MISC_FEATURE (363)..(363): Xaa is Gln or absent
MKRXRXXXXXNPVYPYXXXXXXXXPFXXPPFVXXDGXXEXPXGXLSLXIXKPLXFXXXXXXXLSLGXGLXXXSAGXLEXXQXXXXXPPLXXXXNXXSXXXXXPLXXXXNXLXLXYXXPLRXVXXXLTFNXTSPLXXXXXXLTFXYTXPLXXXNNSLAXXXXXXXXXXXXXXXXXXXLXXXXXXXXXXXXXXXXXXXXXXXXTXXXXXXFXXXXSXLSLXXXXXXXXXXXXXXXLXXXAGXXLXXXXXXXXXXXXXXXXXXXXXXPLXXXXXGXXXXXXXXXXXXXXXLXXXXXXXXXXXGXXXXXXXXXXXXXXXXGXXXXXXXLXXXXNXXXXXXXXXXXXXXXXXXXXXXXXXXXXXXXXX

SEQ ID NO: 267 - protein, 560 aa, Artificial Sequence
  Seq_267 is a consensus majority sequence of SEQ ID NOs: 146-149, 152, and 156
  MISC_FEATURE (4)..(4): Xaa is Ala or Val
  MISC_FEATURE (6)..(6): Xaa is Val or Ile
  MISC_FEATURE (18)..(18): Xaa is Pro or Ser
  MISC_FEATURE (20)..(20): Xaa is Tyr, Asn, or His
  MISC_FEATURE (23)..(23): Xaa is Ile or Val
  MISC_FEATURE (42)..(42): Xaa is Leu or Phe
  MISC_FEATURE (47)..(47): Xaa is Leu or Ile
  MISC_FEATURE (50)..(50): Xaa is Lys or Arg
  MISC_FEATURE (53)..(53): Xaa is Ile or Val
  MISC_FEATURE (62)..(62): Xaa is Val or Leu
  MISC_FEATURE (64)..(64): Xaa is Leu, Ile, or Val
  MISC_FEATURE (66)..(66): Xaa is Asn or Ser
  MISC_FEATURE (69)..(69): Xaa is Thr, Ser, or Asn
  MISC_FEATURE (70)..(70): Xaa is Ile or Leu
  MISC_FEATURE (71)..(71): Xaa is Asn or Asp
  MISC_FEATURE (72)..(72): Xaa is Asn or Asp
  MISC_FEATURE (80)..(80): Xaa is Ala or Gln
  MISC_FEATURE (81)..(81): Xaa is Gly or Thr
  MISC_FEATURE (82)..(82): Xaa is Glu or Thr
  MISC_FEATURE (84)..(84): Xaa is Glu or Thr
  MISC_FEATURE (90)..(90): Xaa is Ala, Glu, or Asn
  MISC_FEATURE (91)..(91): Xaa is Asn or Ser
  MISC_FEATURE (92)..(92): Xaa is Asp or Asn
  MISC_FEATURE (93)..(93): Xaa is Lys or Thr
  MISC_FEATURE (95)..(95): Xaa is Ala or Gly
  MISC_FEATURE (97)..(97): Xaa is Val or Ala
  MISC_FEATURE (100)..(100): Xaa is Asp, Glu, or Gln
  MISC_FEATURE (103)..(103): Xaa is Ala or Thr
  MISC_FEATURE (105)..(105): Xaa is Lys or Glu
  MISC_FEATURE (106)..(106): Xaa is Arg, Asn, or Ser
  MISC_FEATURE (108)..(108): Xaa is Ser or Arg
  MISC_FEATURE (109)..(109): Xaa is Leu or Ile
  MISC_FEATURE (110)..(110): Xaa is Thr or Ile
  MISC_FEATURE (111)..(111): Xaa is Leu or Val
  MISC_FEATURE (113)..(113): Xaa is His or Tyr
  MISC_FEATURE (114)..(114): Xaa is Ser, Thr, or Asn
  MISC_FEATURE (117)..(117): Xaa is Leu or Phe
  MISC_FEATURE (118)..(118): Xaa is Val or Ala
  MISC_FEATURE (119)..(119): Xaa is Ile or Val
  MISC_FEATURE (120)..(120): Xaa is Ala, Ser, or Thr
  MISC_FEATURE (121)..(121): Xaa is Asp, Asn, or Gly
  MISC_FEATURE (122)..(122): Xaa is Asn, His, or Asp
  MISC_FEATURE (125)..(125): Xaa is Ala, Ser, or Gly
  MISC_FEATURE (127)..(127): Xaa is Gln or Lys
  MISC_FEATURE (128)..(128): Xaa is Thr or Val
  MISC_FEATURE (129)..(129): Xaa is Ser or Thr
  MISC_FEATURE (130)..(130): Xaa is Glu or Thr
  MISC_FEATURE (132)..(132): Xaa is Ile or Phe
  MISC_FEATURE (135)..(135): Xaa is Asn or Asp
  MISC_FEATURE (136)..(136): Xaa is Asp or Gln
  MISC_FEATURE (137)..(137): Xaa is Lys, Gln, or Asp
  MISC_FEATURE (138)..(138): Xaa is Asp or Asn
  MISC_FEATURE (139)..(139): Xaa is Lys or Glu
  MISC_FEATURE (143)..(143): Xaa is Gln or Ser
  MISC_FEATURE (145)..(145): Xaa is Ala or Asp
  MISC_FEATURE (149)..(149): Xaa is Val, Gln, or Lys
  MISC_FEATURE (150)..(150): Xaa is Thr or Val
  MISC_FEATURE (151)..(151): Xaa is Asn or Thr
  MISC_FEATURE (154)..(154): Xaa is Thr or Ser
  MISC_FEATURE (165)..(165): Xaa is Ile or Leu
  MISC_FEATURE (166)..(166): Xaa is Ala or Val
  MISC_FEATURE (167)..(167): Xaa is Asp or Glu
  MISC_FEATURE (168)..(168): Xaa is Gln, Asn, or Glu
  MISC_FEATURE (171)..(171): Xaa is Lys or Arg
  MISC_FEATURE (175)..(175): Xaa is Thr or Ser
  MISC_FEATURE (176)..(176): Xaa is Asn or Lys
  MISC_FEATURE (179)..(179): Xaa is Tyr or Phe
  MISC_FEATURE (182)..(182): Xaa is Asn, Asp, or Gly
  MISC_FEATURE (183)..(183): Xaa is Asn or Asp
  MISC_FEATURE (186)..(186): Xaa is Thr, Ser, or Ala
  MISC_FEATURE (188)..(188): Xaa is Ala or Gly
  MISC_FEATURE (196)..(196): Xaa is Thr or Ala
  MISC_FEATURE (197)..(197): Xaa is Asn, Ser, or Ala
  MISC_FEATURE (198)..(198): Xaa is Ser or Ala
  MISC_FEATURE (200)..(200): Xaa is Lys, Asn, or Thr
  MISC_FEATURE (202)..(202): Xaa is Ala or Thr
  MISC_FEATURE (203)..(203): Xaa is Leu or Val
  MISC_FEATURE (206)..(206): Xaa is Ser, Asn, or Thr
  MISC_FEATURE (209)..(209): Xaa is Leu or Phe
  MISC_FEATURE (210)..(210): Xaa is Gln, Lys, or Thr
  MISC_FEATURE (211)..(211): Xaa is Ser or Thr
  MISC_FEATURE (212)..(212): Xaa is Ala, Thr, or Asn
  MISC_FEATURE (213)..(213): Xaa is Asp or Ser
  MISC_FEATURE (214)..(214): Xaa is Thr, Asp, or Ser
  MISC_FEATURE (217)..(217): Xaa is Thr or Ala
  MISC_FEATURE (218)..(218): Xaa is Leu or Ile
  MISC_FEATURE (219)..(219): Xaa is Gln or Ser
  MISC_FEATURE (220)..(220): Xaa is Thr or Leu
  MISC_FEATURE (221)..(221): Xaa is Asn, Ser, Val, or Ala
  MISC_FEATURE (222)..(222): Xaa is Val, Asn, Glu, or Asp
  MISC_FEATURE (224)..(224): Xaa is Leu or Val
  MISC_FEATURE (226)..(226): Xaa is Val or Ile
  MISC_FEATURE (227)..(227): Xaa is Ser or Lys
  MISC_FEATURE (230)..(230): Xaa is Thr or Asn
  MISC_FEATURE (232)..(232): Xaa is Gly or Ala
  MISC_FEATURE (233)..(233): Xaa is Leu or Met
  MISC_FEATURE (234)..(234): Xaa is Ala, Ser, Gln, or Arg
  MISC_FEATURE (236)..(236): Xaa is Lys or Ser
  MISC_FEATURE (239)..(239): Xaa is Leu or Phe
  MISC_FEATURE (240)..(240): Xaa is Ile or Val
  MISC_FEATURE (241)..(241): Xaa is Val or Ile
  MISC_FEATURE (242)..(242): Xaa is Gln or Asp
  MISC_FEATURE (243)..(243): Xaa is Asp or Asn
  MISC_FEATURE (244)..(244): Xaa is Asn or Ser
  MISC_FEATURE (245)..(245): Xaa is Lys, Asn, or Ser
  MISC_FEATURE (247)..(247): Xaa is Phe, Tyr, or Ser
  MISC_FEATURE (248)..(248): Xaa is Met or Leu
  MISC_FEATURE (249)..(249): Xaa is Asp or Ala
  MISC_FEATURE (250)..(250): Xaa is Phe, Ile, or Leu
  MISC_FEATURE (251)..(251): Xaa is Arg or Thr
  MISC_FEATURE (252)..(252): Xaa is Ala or Pro
  MISC_FEATURE (258)..(258): Xaa is Asn or Asp
  MISC_FEATURE (260)..(260): Xaa is Asp or Glu
  MISC_FEATURE (262)..(262): Xaa is Val or Gln
  MISC_FEATURE (265)..(265): Xaa is Leu or Val
  MISC_FEATURE (266)..(266): Xaa is Asn, His, or Gly
  MISC_FEATURE (268)..(268): Xaa is Tyr, Asn, or Thr
  MISC_FEATURE (269)..(269): Xaa is Thr, Pro, or Phe
  MISC_FEATURE (271)..(271): Xaa is Leu or Ile
  MISC_FEATURE (272)..(272): Xaa is Ala or Thr
  MISC_FEATURE (274)..(274): Xaa is Arg, Gln, Thr, or Val
  MISC_FEATURE (275)..(275): Xaa is Asp, Gln, or Asn
  MISC_FEATURE (276)..(276): Xaa is Glu, Gly, or Asn
  MISC_FEATURE (277)..(277): Xaa is Ala, Gly, or Leu
  MISC_FEATURE (279)..(279): Xaa is Thr, Ala, or Ser
  MISC_FEATURE (280)..(280): Xaa is Val or Leu
  MISC_FEATURE (282)..(282): Xaa is Thr, Met, or Ile
  MISC_FEATURE (284)..(284): Xaa is Arg, Asp, or Asn
  MISC_FEATURE (286)..(286): Xaa is Leu or Val
  MISC_FEATURE (287)..(287): Xaa is Thr, Gln, or Lys
  MISC_FEATURE (288)..(288): Xaa is Val or Leu
  MISC_FEATURE (289)..(289): Xaa is Ser, Tyr, Thr, or Leu
  MISC_FEATURE (290)..(290): Xaa is Tyr or Leu
  MISC_FEATURE (291)..(291): Xaa is Asp or Asn
  MISC_FEATURE (292)..(292): Xaa is Gly or Lys
  MISC_FEATURE (294)..(294): Xaa is Ile or Thr
  MISC_FEATURE (295)..(295): Xaa is Leu or Ala
  MISC_FEATURE (297)..(297): Xaa is Leu or Ile
  MISC_FEATURE (299)..(299): Xaa is Lys or Arg
  MISC_FEATURE (302)..(302): Xaa is Arg or Gln
  MISC_FEATURE (303)..(303): Xaa is Phe or Tyr
  MISC_FEATURE (304)..(304): Xaa is Asp, Glu, or Gln
  MISC_FEATURE (306)..(306): Xaa is Asn or Gly
  MISC_FEATURE (307)..(307): Xaa is Thr, Ser, or Ala
  MISC_FEATURE (308)..(308): Xaa is Val, Leu, or Ile
  MISC_FEATURE (309)..(309): Xaa is Ser, Val, or Ala
  MISC_FEATURE (311)..(311): Xaa is Ala, Lys, Thr, or Ser
  MISC_FEATURE (313)..(313): Xaa is Ser or Thr
  MISC_FEATURE (314)..(314): Xaa is Ala, Pro, or Thr
  MISC_FEATURE (315)..(315): Xaa is Ala or Glu
  MISC_FEATURE (316)..(316): Xaa is Leu or Pro
  MISC_FEATURE (322)..(322): Xaa is Asp, Thr, or Asn
  MISC_FEATURE (323)..(323): Xaa is Gln or Lys
  MISC_FEATURE (325)..(325): Xaa is Arg or Gln
  MISC_FEATURE (328)..(328): Xaa is Val, Met, or Ile
  MISC_FEATURE (333)..(333): Xaa is Arg or His
  MISC_FEATURE (334)..(334): Xaa is Tyr or Leu
  MISC_FEATURE (335)..(335): Xaa is Asn or Gly
  MISC_FEATURE (336)..(336): Xaa is Pro, Gly, or absent
  MISC_FEATURE (337)..(337): Xaa is Val or Ala
  MISC_FEATURE (338)..(338): Xaa is Ser or Thr
  MISC_FEATURE (339)..(339): Xaa is Lys or Arg
  MISC_FEATURE (340)..(340): Xaa is Lys or Gln
  MISC_FEATURE (342)..(342): Xaa is Asp or Thr
  MISC_FEATURE (343)..(343): Xaa is Val or Leu
  MISC_FEATURE (344)..(344): Xaa is Asn or Asp
  MISC_FEATURE (345)..(345): Xaa is Pro, Val, or Ile
  MISC_FEATURE (346)..(346): Xaa is Asn or Asp
  MISC_FEATURE (347)..(347): Xaa is Gln or Thr
  MISC_FEATURE (348)..(348): Xaa is Asn or Gln
  MISC_FEATURE (349)..(349): Xaa is Lys or Arg
  MISC_FEATURE (354)..(354): Xaa is Glu, Asn, or Asp
  MISC_FEATURE (356)..(356): Xaa is Asp or Asn
  MISC_FEATURE (357)..(357): Xaa is Tyr, Lys, or Ala
  MISC_FEATURE (358)..(358): Xaa is Leu or Val
  MISC_FEATURE (359)..(359): Xaa is Ile, Ala, or Val
  MISC_FEATURE (360)..(360): Xaa is Val or Pro
  MISC_FEATURE (361)..(361): Xaa is Lys or Asn
  MISC_FEATURE (364)..(364): Xaa is Asn, Asp, Ser, or Gln
  MISC_FEATURE (367)..(367): Xaa is Gly, Gln, or Tyr
  MISC_FEATURE (369)..(369): Xaa is Asp or Asn
  MISC_FEATURE (370)..(370): Xaa is Gly, Ser, or Pro
  MISC_FEATURE (371)..(371): Xaa is Asn, Tyr, or Gln
  MISC_FEATURE (373)..(373): Xaa is Asn or Gln
  MISC_FEATURE (375)..(375): Xaa is Ala or Ile
  MISC_FEATURE (376)..(376): Xaa is Val, Pro, or Met
  MISC_FEATURE (377)..(377): Xaa is Ser, Ile, or absent
  MISC_FEATURE (378)..(378): Xaa is Pro or absent
  MISC_FEATURE (379)..(379): Xaa is Gln, Glu, Thr, or absent
  MISC_FEATURE (380)..(380): Xaa is Val, Thr, or Asn
  MISC_FEATURE (381)..(381): Xaa is Thr or Val
  MISC_FEATURE (382)..(382): Xaa is Ser or Lys
  MISC_FEATURE (383)..(383): Xaa is Lys or Pro
  MISC_FEATURE (384)..(384): Xaa is Asp or Gln
  MISC_FEATURE (398)..(398): Xaa is Ile or Val
  MISC_FEATURE (400)..(400): Xaa is Thr, Lys, or Gln
  MISC_FEATURE (401)..(401): Xaa is Asp or Asn
  MISC_FEATURE (405)..(405): Xaa is Lys or Arg
  MISC_FEATURE (406)..(406): Xaa is Met or Leu
  MISC_FEATURE (409)..(409): Xaa is Ser or Ala
  MISC_FEATURE (413)..(413): Xaa is Gln, Ser, or Cys
  MISC_FEATURE (415)..(415): Xaa is Gly or Asp
  MISC_FEATURE (416)..(416): Xaa is Val or Met
  MISC_FEATURE (418)..(418): Xaa is His or Gln
  MISC_FEATURE (421)..(421): Xaa is Val or Ile
  MISC_FEATURE (424)..(424): Xaa is Lys or Gln
  MISC_FEATURE (426)..(426): Xaa is Leu or Gln
  MISC_FEATURE (428)..(428): Xaa is Gly or Asp
  MISC_FEATURE (431)..(431): Xaa is Leu or Met
  MISC_FEATURE (432)..(432): Xaa is Ser or Asn
  MISC_FEATURE (433)..(433): Xaa is Pro or Val
  MISC_FEATURE (435)..(435): Xaa is Glu, Asp, or Ala
  MISC_FEATURE (436)..(436): Xaa is Ser or Pro
  MISC_FEATURE (437)..(437): Xaa is Ala, Phe, Tyr, or Ser
  MISC_FEATURE (438)..(438): Xaa is Ile or Val
  MISC_FEATURE (439)..(439): Xaa is Val, Thr, or Ser
  MISC_FEATURE (441)..(441): Xaa is Ile or Val
  MISC_FEATURE (442)..(442): Xaa is Ile or Leu
  MISC_FEATURE (443)..(443): Xaa is His or Tyr
  MISC_FEATURE (445)..(445): Xaa is Asp, Tyr, or Asn
  MISC_FEATURE (446)..(446): Xaa is Asn, Glu, Ser, or Asp
  MISC_FEATURE (447)..(447): Xaa is Tyr or Asn
  MISC_FEATURE (451)..(451): Xaa is Ile, Arg, or absent
  MISC_FEATURE (452)..(452): Xaa is Leu, Ala, Thr, or Ile
  MISC_FEATURE (453)..(453): Xaa is Asn or Pro
  MISC_FEATURE (457)..(457): Xaa is Leu or Phe
  MISC_FEATURE (458)..(458): Xaa is Gly or Asp
  MISC_FEATURE (459)..(459): Xaa is Thr or Asn
  MISC_FEATURE (460)..(460): Xaa is Gln or Glu
  MISC_FEATURE (464)..(464): Xaa is Gly or Ala
  MISC_FEATURE (465)..(465): Xaa is Asn, Lys, or Arg
  MISC_FEATURE (466)..(466): Xaa is Asn, Asp, or Ser
  MISC_FEATURE (467)..(467): Xaa is Ala or Ser
  MISC_FEATURE (473)..(473): Xaa is Gln or Glu
  MISC_FEATURE (475)..(475): Xaa is Glu or Pro
  MISC_FEATURE (478)..(478): Xaa is Asp or Asn
  MISC_FEATURE (482)..(482): Xaa is Leu or Thr
  MISC_FEATURE (485)..(485): Xaa is Leu, Thr, or Val
  MISC_FEATURE (486)..(486): Xaa is Ala or Glu
  MISC_FEATURE (490)..(490): Xaa is Ser or Asn
  MISC_FEATURE (492)..(492): Xaa is Lys, Ala, Thr, or Ser
  MISC_FEATURE (496)..(496): Xaa is Arg or Val
  MISC_FEATURE (497)..(497): Xaa is Gly or Asn
  MISC_FEATURE (498)..(498): Xaa is Arg or Lys
  MISC_FEATURE (499)..(499): Xaa is Gly or His
  MISC_FEATURE (500)..(500): Xaa is Ser, Glu, or Asp
  MISC_FEATURE (501)..(501): Xaa is Glu, Gln, or Asn
  MISC_FEATURE (502)..(502): Xaa is Val, Ala, or Ile
  MISC_FEATURE (506)..(506): Xaa is Thr or Ser
  MISC_FEATURE (507)..(507): Xaa is Val or Phe
  MISC_FEATURE (508)..(508): Xaa is Gly or Ser
  MISC_FEATURE (512)..(512): Xaa is Leu or Ile
  MISC_FEATURE (513)..(513): Xaa is Gln or Lys
  MISC_FEATURE (515)..(515): Xaa is Asp or Asn
  MISC_FEATURE (516)..(516): Xaa is Leu or Phe
  MISC_FEATURE (517)..(517): Xaa is Ser or Ala
  MISC_FEATURE (518)..(518): Xaa is Met or Trp
  MISC_FEATURE (520)..(520): Xaa is Val or Ile
  MISC_FEATURE (521)..(521): Xaa is Pro or Phe
  MISC_FEATURE (522)..(522): Xaa is Tyr or Phe
  MISC_FEATURE (523)..(523): Xaa is Gln or Arg
  MISC_FEATURE (524)..(524): Xaa is Ile or Val
  MISC_FEATURE (525)..(525): Xaa is Gln or Thr
  MISC_FEATURE (528)..(528): Xaa is Tyr or His
  MISC_FEATURE (529)..(529): Xaa is Gly, Val, or Ala
  MISC_FEATURE (530)..(530): Xaa is Pro, Arg, Leu or Thr
  MISC_FEATURE (531)..(531): Xaa is Thr or Glu
  MISC_FEATURE (533)..(533): Xaa is Tyr or Phe
  MISC_FEATURE (535)..(535): Xaa is Phe or Leu
  MISC_FEATURE (538)..(538): Xaa is Ile or Thr
  MISC_FEATURE (540)..(540): Xaa is Arg or Gln
  MISC_FEATURE (541)..(541): Xaa is Thr, Val, or Ala
  MISC_FEATURE (543)..(543): Xaa is Ser, Asn, Ala, or Gln
  MISC_FEATURE (544)..(544): Xaa is Arg or Asn
  MISC_FEATURE (546)..(546): Xaa is Pro, Lys, or Ala
  MISC_FEATURE (553)..(553): Xaa is Phe or Ser
  MISC_FEATURE (560)..(560): Xaa is Gln, Glu, or absent
MKRXRXDEDFNPVYPYDXPXAPXMPFITPPFTSSDGLQEKPXGVLSXNYXDPXTTQNGSLTXKXGXGLXXXXQGQLTSTXXXVXPPLTNXXXXLXLXYSXPLXVXXNXXXXSXXAPXXXXXXSLXLXXXXPXFIXXXXXLALXTXAPLXXXAGXLRLQSAAPLGXXXXTLXLLFXXPLXLQXXFLXLXIERPLAIXXXGXLXXQLXPPXXXXXXGLXXXXXXPXTXXNGXLXXXIXRPXXXXXXXLXXXXXXPLRLFXSXPXLGXXFXXPXXVXXXXLXXNXGXGXXXXXXXLXXNXGXDLXXXNXXXXVXLXXXXPLQYTXXLXLNXGAGLXXXXXXXXLXXXXXXXXGLTWXNXXXXXXLGXGLXFXXXGXIXXXXXXXXXXTLWTTADPSPNCSXYXXLDAXXWLXLVKXGXXVXGSXALXAXKXTLXXXTXXXXXIXXXFXXXGVRXXXYPTXXXXGTLXXXXTWGYRXGXSAXTNVXNAXXFMPXSXRYPXXXXXXXQNQXXXYTCXXGXXXXPXXXXXXYNXXXXGXSXKFXWXXVXXQXFDIPCCXFSYITEX

SEQ ID NO: 268 - protein, 506 aa, Artificial Sequence
  Seq_268 is a consensus majority sequence of SEQ ID NOs: 120, 123, 126, and 133
  misc_feature (11)..(11): Xaa can be any naturally occurring amino acid
  misc_feature (13)..(14): Xaa can be any naturally occurring amino acid
  misc_feature (143)..(143): Xaa can be any naturally occurring amino acid
  misc_feature (147)..(147): Xaa can be any naturally occurring amino acid
  misc_feature (149)..(155): Xaa can be any naturally occurring amino acid
  misc_feature (157)..(157): Xaa can be any naturally occurring amino acid
  misc_feature (194)..(194): Xaa can be any naturally occurring amino acid
  misc_feature (280)..(280): Xaa can be any naturally occurring amino acid
  misc_feature (285)..(286): Xaa can be any naturally occurring amino acid
  misc_feature (289)..(289): Xaa can be any naturally occurring amino acid
  misc_feature (291)..(293): Xaa can be any naturally occurring amino acid
  misc_feature (295)..(297): Xaa can be any naturally occurring amino acid
  misc_feature (300)..(301): Xaa can be any naturally occurring amino acid
  misc_feature (308)..(309): Xaa can be any naturally occurring amino acid
  misc_feature (311)..(312): Xaa can be any naturally occurring amino acid
  misc_feature (314)..(314): Xaa can be any naturally occurring amino acid
  misc_feature (316)..(316): Xaa can be any naturally occurring amino acid
  misc_feature (319)..(320): Xaa can be any naturally occurring amino acid
  misc_feature (324)..(324): Xaa can be any naturally occurring amino acid
  misc_feature (329)..(329): Xaa can be any naturally occurring amino acid
  misc_feature (331)..(335): Xaa can be any naturally occurring amino acid
  misc_feature (337)..(337): Xaa can be any naturally occurring amino acid
  misc_feature (351)..(351): Xaa can be any naturally occurring amino acid
MRRAVRVTPAXYXXGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRAXLMVXKXXXXXXXPXYEWFEFTIPEGNYSETMTIDLMNNAIVDNYLQVGRQXGVLESDIGVKFDTRNFRLGWDPVTKLVMPGVYTNEAFHPDIVLLPGCGVDFTQSRLSNLLGIRKRRPFQEGFQIMYEDLEGGNIPXLLDVXXYEXSXXXAXXXGRXXRGDTFAXXPXXLXIXPLXXDSKXRSYNXIXXXXXTXYRSWFLAYNYGDPXKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 269 - protein, 506 aa, Artificial Sequence; identical to SEQ ID NO: 268
  Seq_269  is a consensus majority sequence of SEQ ID NOs: 210-223
  MISC_FEATURE (11)..(11): Xaa is Ala or Val
  MISC_FEATURE (13)..(13): Xaa is Glu or Ala
  MISC_FEATURE (14)..(14): Xaa is Glu or absent
  MISC_FEATURE (143)..(143): Xaa is Lys or Arg
  MISC_FEATURE (147)..(147): Xaa is Glu or Lys
  MISC_FEATURE (149)..(149): Xaa is Ser, Thr, or absent
  MISC_FEATURE (150)..(150): Xaa is Asn or absent
  MISC_FEATURE (151)..(151): Xaa is Ala, Val or Ile
  MISC_FEATURE (152)..(152): Xaa is Glu or Ser
  MISC_FEATURE (153)..(153): Xaa is Thr, Asn, or Gly
  MISC_FEATURE (154)..(154): Xaa is Gln or Arg
  MISC_FEATURE (155)..(155): Xaa is Gln or Pro
  MISC_FEATURE (157)..(157): Xaa is Arg, Lys, or Glu
  MISC_FEATURE (194)..(194): Xaa is Asn or His
  MISC_FEATURE (280)..(280): Xaa is Gly or Ala
  MISC_FEATURE (285)..(285): Xaa is Pro or Ser
  MISC_FEATURE (286)..(286): Xaa is Ala or Lys
  MISC_FEATURE (289)..(289): Xaa is Gln, Asp, Ala or Glu
  MISC_FEATURE (291)..(291): Xaa is Leu, Val or Ile
  MISC_FEATURE (292)..(292): Xaa is Gln or Lys
  MISC_FEATURE (293)..(293): Xaa is Gln, Lys or Arg
  MISC_FEATURE (295)..(295): Xaa is Gln, Glu or Lys
  MISC_FEATURE (296)..(296): Xaa is Glu or Ala
  MISC_FEATURE (297)..(297): Xaa is Glu or Gln
  MISC_FEATURE (300)..(300): Xaa is Val or Glu
  MISC_FEATURE (301)..(301): Xaa is Thr or Ile
  MISC_FEATURE (308)..(308): Xaa is Thr or Val
  MISC_FEATURE (309)..(309): Xaa is Ala or Glu
  MISC_FEATURE (311)..(311): Xaa is His or Gln
  MISC_FEATURE (312)..(312): Xaa is Glu, Asp or Ala
  MISC_FEATURE (314)..(314): Xaa is Val or Glu
  MISC_FEATURE (316)..(316): Xaa is Gln, Glu, Lys or Val
  MISC_FEATURE (319)..(319): Xaa is Thr or Glu
  MISC_FEATURE (320)..(320): Xaa is Lys, Glu or Gln
  MISC_FEATURE (324)..(324): Xaa is Asn, Lys or Asp
  MISC_FEATURE (329)..(329): Xaa is Leu or Ile
  MISC_FEATURE (331)..(331): Xaa is Pro, Thr, Asn or Ser
  MISC_FEATURE (332)..(332): Xaa is Asn or Gly
  MISC_FEATURE (333)..(333): Xaa is Ser or Thr
  MISC_FEATURE (334)..(334): Xaa is Thr or Met
  MISC_FEATURE (335)..(335): Xaa is Asp or Asn
  MISC_FEATURE (337)..(337): Xaa is Leu, Glu, Lys or Gln
  MISC_FEATURE (351)..(351): Xaa is Glu or Asp

SEQ ID NO: 270 - protein, 506 aa, Artificial Sequence
  Seq_270 is a consensus majority sequence of SEQ ID NOs: 210-213, 218, and 222
  MISC_FEATURE (11)..(11): Xaa is Ala or Val
  MISC_FEATURE (13)..(13): Xaa is Glu or Ala
  MISC_FEATURE (14)..(14): Xaa is Glu or Absent
  MISC_FEATURE (147)..(147): Xaa is Lys or Glu
  MISC_FEATURE (149)..(149): Xaa is Val, Ile, Ala, or Thr
  MISC_FEATURE (150)..(150): Xaa is Ser, Glu, or Asn
  MISC_FEATURE (151)..(151): Xaa is Gly, Asn, or Ala
  MISC_FEATURE (152)..(152): Xaa is Gln or Glu (152)
  MISC_FEATURE (153)..(153): Xaa is Pro or Thr
  MISC_FEATURE (154)..(154): Xaa is Gln or Absent
  MISC_FEATURE (155)..(155): Xaa is Gln or Absent
  MISC_FEATURE (157)..(157): Xaa is Glu, Lys, or Arg
  MISC_FEATURE (280)..(280): Xaa is Ala or Gly
  MISC_FEATURE (285)..(285): Xaa is Pro or Ser
  MISC_FEATURE (286)..(286): Xaa is Ala or Lys
  MISC_FEATURE (289)..(289): Xaa is Asp or Ala
  MISC_FEATURE (292)..(292): Xaa is Lys or Gln
  MISC_FEATURE (293)..(293): Xaa is Lys or Arg
  MISC_FEATURE (297)..(297): Xaa is Gln or Glu
  MISC_FEATURE (308)..(308): Xaa is Thr or Val
  MISC_FEATURE (309)..(309): Xaa is Glu or Ala
  MISC_FEATURE (311)..(311): Xaa is His or Gln
  MISC_FEATURE (312)..(312): Xaa is Ala or Asp
  MISC_FEATURE (316)..(316): Xaa is Lys or Glu
  MISC_FEATURE (320)..(320): Xaa is Glu or Lys
  MISC_FEATURE (324)..(324): Xaa is Lys or Asn
  MISC_FEATURE (334)..(334): Xaa is Met or Thr
  MISC_FEATURE (337)..(337): Xaa is Glu, Gln, or Lys
  MISC_FEATURE (351)..(351): Xaa is Glu or Asp
  MISC_FEATURE (393)..(393): Xaa is Ser or Gly
MRRAVRVTPAXYXXGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRARLMVXKXXXXXXXPXYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPXLLDVXXYEXSVXXAEAXGREIRGDTFAXXPXXLVIXPLTXDSKXRSYNIITGTXDTXYRSWFLAYNYGDPXKGVRSWTILTTTDVTCGSQQVYWSLPDMMQDPVTFRPSTQVXNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 271 - protein, 942 aa, Artificial Sequence
  Seq_271 is a consensus majority sequence of SEQ ID NOs: 158-171
  MISC_FEATURE (84)..(84): Xaa is Phe or Tyr
  MISC_FEATURE (106)..(106): Xaa is Met or Val
  MISC_FEATURE (133)..(133): Xaa is Ala or Ser
  MISC_FEATURE (134)..(134): Xaa is Glu or Gln
  MISC_FEATURE (136)..(136): Xaa is Ala, Glu, Ile, Asn, or Thr
  MISC_FEATURE (137)..(137): Xaa is Asp, Gly, Asn, or Thr
  MISC_FEATURE (138)..(138): Xaa is Asn, Ser, or Thr
  MISC_FEATURE (139)..(139): Xaa is Asp, Gly, Asn, or Ser
  MISC_FEATURE (140)..(140): Xaa is Asp, Gly, or absent
  MISC_FEATURE (141)..(141): Xaa is Ser, Thr, or absent
  MISC_FEATURE (142)..(142): Xaa is Ala, Asn, or Ser
  MISC_FEATURE (144)..(144): Xaa is Leu, Thr, or Val
  MISC_FEATURE (145)..(145): Xaa is His, Lys, or Asn
  MISC_FEATURE (146)..(146): Xaa is Ala, Ser, or Val
  MISC_FEATURE (147)..(147): Xaa is Phe, Arg, or Tyr
  MISC_FEATURE (148)..(148): Xaa is Ala or Gly
  MISC_FEATURE (151)..(151): Xaa is Pro or Ser
  MISC_FEATURE (152)..(152): Xaa is Phe or Tyr
  MISC_FEATURE (153)..(153): Xaa is Ile, Gln, or Val
  MISC_FEATURE (154)..(154): Xaa is Gly or Ser
  MISC_FEATURE (155)..(155): Xaa is Ser, Thr, or absent
  MISC_FEATURE (156)..(156): Xaa is Phe, Tyr, or absent
  MISC_FEATURE (157)..(157): Xaa is Gly or absent
  MISC_FEATURE (158)..(158): Xaa is Ala, Met, or absent
  MISC_FEATURE (159)..(159): Xaa is Ala, Gly, Asn, or absent
  MISC_FEATURE (160)..(160): Xaa is Ala, Asp, Asn, Gln, or Thr
  MISC_FEATURE (161)..(161): Xaa is Ala, Glu, Gly, or Asn
  MISC_FEATURE (162)..(162): Xaa is Ile or Leu
  MISC_FEATURE (164)..(164): Xaa is Lys or Thr
  MISC_FEATURE (165)..(165): Xaa is Asp, Glu, or Asn
  MISC_FEATURE (167)..(167): Xaa is Ile or Val
  MISC_FEATURE (168)..(168): Xaa is Lys or Gln
  MISC_FEATURE (170)..(170): Xaa is Ala or Gly
  MISC_FEATURE (171)..(171): Xaa is Leu, Thr, or Val
  MISC_FEATURE (172)..(172): Xaa is Asp, Ile, Thr, or Val
  MISC_FEATURE (173)..(173): Xaa is Leu, Thr, or Val
  MISC_FEATURE (174)..(174): Xaa is Gly, Asn, Ser, or Thr
  MISC_FEATURE (175)..(175): Xaa is Asp, Glu, or Asn
  MISC_FEATURE (176)..(176): Xaa is Ala, His, Pro, or Ser
  MISC_FEATURE (177)..(177): Xaa is Ala, Gly, Asn, or Thr
  MISC_FEATURE (178)..(178): Xaa is Ala, Gln, Arg, or Ser
  MISC_FEATURE (179)..(179): Xaa is Thr or absent
  MISC_FEATURE (180)..(180): Xaa is Ala or Pro
  MISC_FEATURE (181)..(181): Xaa is Ile, Gln, or Val
  MISC_FEATURE (184)..(184): Xaa is Asp, Lys, or Asn
  MISC_FEATURE (186)..(186): Xaa is Ala, Glu, Ile, Ser, Thr, or Val
  MISC_FEATURE (193)..(193): Xaa is Ile or Val
  MISC_FEATURE (195)..(195): Xaa is Glu or Thr
  MISC_FEATURE (196)..(196): Xaa is Leu, Asn, Gln, Ser, or Thr
  MISC_FEATURE (197)..(197): Xaa is Glu, Gln, or Arg
  MISC_FEATURE (200)..(200): Xaa is Ser or absent
  MISC_FEATURE (201)..(201): Xaa is Asp, Glu, or absent
  MISC_FEATURE (202)..(202): Xaa is Ile, Leu, or Val
  MISC_FEATURE (203)..(203): Xaa is Glu, Gly, or Asn
  MISC_FEATURE (204)..(204): Xaa is Ala, Asn, Gln, Pro, or Thr
  MISC_FEATURE (205)..(205): Xaa is Asp, Glu, Asn, or Thr
  MISC_FEATURE (206)..(206): Xaa is Asp or Gln
  MISC_FEATURE (207)..(207): Xaa is Lys or Asn
  MISC_FEATURE (208)..(208): Xaa is Ala, Ile, Leu, or Val
  MISC_FEATURE (212)..(212): Xaa is Ile or Val
  MISC_FEATURE (215)..(215): Xaa is Lys or Pro
  MISC_FEATURE (216)..(216): Xaa is Asp, Ser, or Thr
  MISC_FEATURE (220)..(220): Xaa is Phe, Gln, or Val
  MISC_FEATURE (228)..(228): Xaa is Lys, Arg, or Tyr
  MISC_FEATURE (232)..(232): Xaa is Ala, Asp, or Glu
  MISC_FEATURE (233)..(233): Xaa is Glu, Lys, Asn, or Gln
  MISC_FEATURE (237)..(237): Xaa is Ala or Val
  MISC_FEATURE (238)..(238): Xaa is Ile, Lys, or Thr
  MISC_FEATURE (239)..(239): Xaa is Ile, Asn, Pro, or Gln
  MISC_FEATURE (240)..(240): Xaa is Pro, Gln, Ser, or Thr
  MISC_FEATURE (241)..(241): Xaa is Ala, Asp, Gly, or Glu
  MISC_FEATURE (242)..(242): Xaa is Ser, Gly, or absent
  MISC_FEATURE (243)..(243): Xaa is Ser, Gly, Thr, or absent
  MISC_FEATURE (244)..(244): Xaa is Gln, Thr, Ser, or absent
  MISC_FEATURE (245)..(245): Xaa is Gly, Asp, Glu, or absent
  MISC_FEATURE (246)..(246): Xaa is Val, Thr, Pro, Asp, Ala, or absent
  MISC_FEATURE (247)..(247): Xaa is Gln, Thr, or absent
  MISC_FEATURE (248)..(248): Xaa is Asn, Gly, or absent
  MISC_FEATURE (249)..(249): Xaa is Pro, Ala, or absent
  MISC_FEATURE (250)..(250): Xaa is Asn or absent
  MISC_FEATURE (251)..(251): Xaa is Ala, Ser, or absent
  MISC_FEATURE (252)..(252): Xaa is Pro or Val
  MISC_FEATURE (253)..(253): Xaa is Glu, Ser, or Asp
  MISC_FEATURE (254)..(254): Xaa is Leu or Met
  MISC_FEATURE (255)..(255): Xaa is Gln or Glu
  MISC_FEATURE (258)..(258): Xaa is Ala, Thr, or Ser
  MISC_FEATURE (259)..(259): Xaa is Ala, Thr, or Ser
  MISC_FEATURE (260)..(260): Xaa is Ser, Thr, Gly, or Pro
  MISC_FEATURE (261)..(261): Xaa is Asn, Ser, Ala, or Gly
  MISC_FEATURE (262)..(262): Xaa is Thr, Gly, or absent
  MISC_FEATURE (263)..(263): Xaa is Val, Thr, Ser, Asn, or Ala
  MISC_FEATURE (264)..(264): Xaa is Ala, Val, Gln, Asn, or Thr
  MISC_FEATURE (265)..(265): Xaa is Asn or Thr
  MISC_FEATURE (266)..(266): Xaa is Thr or Gln
  MISC_FEATURE (267)..(267): Xaa is Pro or Ala
  MISC_FEATURE (269)..(269): Xaa is Ala or Val
  MISC_FEATURE (273)..(273): Xaa is Ser or Ala
  MISC_FEATURE (275)..(275): Xaa is Asn or Asp
  MISC_FEATURE (277)..(277): Xaa is Ala, Asn, Thr, or Ser
  MISC_FEATURE (278)..(278): Xaa is Ile or Leu
  MISC_FEATURE (280)..(280): Xaa is Thr or Ala
  MISC_FEATURE (290)..(290): Xaa is Thr, Ser, Asp, Ile, or absent
  MISC_FEATURE (291)..(291): Xaa is Val or absent
  MISC_FEATURE (292)..(292): Xaa is Thr, Ala, or Asp
  MISC_FEATURE (293)..(293): Xaa is Glu, Asp, or Ala
  MISC_FEATURE (294)..(294): Xaa is Gly, Asn, or Asp
  MISC_FEATURE (295)..(295): Xaa is Ile, Thr, Ala, Val, or Ser
  MISC_FEATURE (296)..(296): Xaa is Thr or Lys
  MISC_FEATURE (297)..(297): Xaa is Ser, Ala, or Asn
  MISC_FEATURE (298)..(298): Xaa is Ser or Ala
  MISC_FEATURE (299)..(299): Xaa is Glu or Lys
  MISC_FEATURE (300)..(300): Xaa is Ala, Leu, or Thr
  MISC_FEATURE (303)..(303): Xaa is Ser, Ala, Gly, or Thr
  MISC_FEATURE (306)..(306): Xaa is Ala or Ser
  MISC_FEATURE (315)..(315): Xaa is Ala or Gly
  MISC_FEATURE (388)..(388): Xaa is Ile or Val
  MISC_FEATURE (405)..(405): Xaa is Gly or Asn
  MISC_FEATURE (407)..(407): Xaa is Met, Gln, or Thr
  MISC_FEATURE (408)..(408): Xaa is Val, Ala, or Gly
  MISC_FEATURE (409)..(409): Xaa is Val or Ile
  MISC_FEATURE (410)..(410): Xaa is Thr or Ser
  MISC_FEATURE (411)..(411): Xaa is Asp or Asn
  MISC_FEATURE (412)..(412): Xaa is Thr or Asn
  MISC_FEATURE (414)..(414): Xaa is Ser, Arg, Thr, Asn, or Lys
  MISC_FEATURE (415)..(415): Xaa is Pro, Gly, or Ser
  MISC_FEATURE (416)..(416): Xaa is Ile, Leu or Val
  MISC_FEATURE (417)..(417): Xaa is Thr, Lys, Ser, or Gln
  MISC_FEATURE (418)..(418): Xaa is Leu, Val, or Pro
  MISC_FEATURE (419)..(419): Xaa is Ser, Asn, Asp, or Gln
  MISC_FEATURE (420)..(420): Xaa is Gly, Asn, Asp, Thr, or Ser
  MISC_FEATURE (421)..(421): Xaa is Gly, Asn, Ala, or Ser
  MISC_FEATURE (422)..(422): Xaa is Gly or Gln
  MISC_FEATURE (423)..(423): Xaa is Asn, Gly, Thr, or Ser
  MISC_FEATURE (424)..(424): Xaa is Gly, Val, or absent
  MISC_FEATURE (425)..(425): Xaa is Asn or absent
  MISC_FEATURE (426)..(426): Xaa is Gly, Thr, or absent
  MISC_FEATURE (427)..(427): Xaa is Thr or Trp
  MISC_FEATURE (428)..(428): Xaa is Glu, Gln, Phe, Thr, or Val
  MISC_FEATURE (429)..(429): Xaa is Gln, Ala, or Ser
  MISC_FEATURE (430)..(430): Xaa is Asn, Ala, Asp, or Lys
  MISC_FEATURE (431)..(431): Xaa is Asn, Asp, or Thr
  MISC_FEATURE (432)..(432): Xaa is Gly, Asn, Asp, or Thr
  MISC_FEATURE (433)..(433): Xaa is Val, Ala, or Thr
  MISC_FEATURE (434)..(434): Xaa is Phe, Tyr, Ala, or Val
  MISC_FEATURE (435)..(435): Xaa is Thr, Ala, Glu, or Ser
  MISC_FEATURE (436)..(436): Xaa is Glu, Asn, Asp, Thr, or Gln
  MISC_FEATURE (437)..(437): Xaa is Arg or Asn
  MISC_FEATURE (438)..(438): Xaa is Gly or absent
  MISC_FEATURE (439)..(439): Xaa is Ile, Ala, Val, or absent
  MISC_FEATURE (440)..(440): Xaa is Glu or Gln
  MISC_FEATURE (442)..(442): Xaa is Gly or Ser
  MISC_FEATURE (443)..(443): Xaa is Ser or Ile
  MISC_FEATURE (446)..(446): Xaa is Met, Leu, or Ile
  MISC_FEATURE (449)..(449): Xaa is Met or Leu
  MISC_FEATURE (454)..(454): Xaa is Gln or Ala
  MISC_FEATURE (466)..(466): Xaa is Ile or Val
  MISC_FEATURE (467)..(467): Xaa is Gly or Ala
  MISC_FEATURE (473)..(473): Xaa is Ser or Thr
  MISC_FEATURE (474)..(474): Xaa is Leu or Tyr
  MISC_FEATURE (476)..(476): Xaa is Ile or Tyr
  MISC_FEATURE (482)..(482): Xaa is Thr or Glu
  MISC_FEATURE (485)..(485): Xaa is Glu, Asp, or Thr
  MISC_FEATURE (487)..(487): Xaa is Lys or Gln
  MISC_FEATURE (489)..(489): Xaa is Thr or Ser
  MISC_FEATURE (491)..(491): Xaa is Gln or Gly
  MISC_FEATURE (493)..(493): Xaa is Met or Ile
  MISC_FEATURE (499)..(499): Xaa is Ala or Pro
  MISC_FEATURE (501)..(501): Xaa is Gly or Asn
  MISC_FEATURE (502)..(502): Xaa is Leu or Ala
  MISC_FEATURE (503)..(503): Xaa is Val or Ile
  MISC_FEATURE (509)..(509): Xaa is Val or Ile
  MISC_FEATURE (517)..(517): Xaa is Val or Pro
  MISC_FEATURE (520)..(520): Xaa is Ser, Asn, or Gly
  MISC_FEATURE (521)..(521): Xaa is Ile or Val
  MISC_FEATURE (585)..(585): Xaa is Ser or Thr
  MISC_FEATURE (597)..(597): Xaa is Ile or Val
  MISC_FEATURE (757)..(757): Xaa is Ile or Val
  MISC_FEATURE (794)..(794): Xaa is Ile or Val
  MISC_FEATURE (797)..(797): Xaa is Ser or Thr
  MISC_FEATURE (798)..(798): Xaa is Thr or Val
  MISC_FEATURE (799)..(799): Xaa is Asn, Ala, Ser, or Thr
  MISC_FEATURE (801)..(801): Xaa is Thr, Ala, or Lys
  MISC_FEATURE (802)..(802): Xaa is Asn or Asp
  MISC_FEATURE (803)..(803): Xaa is Tyr or absent
  MISC_FEATURE (805)..(805): Xaa is Gln or Lys
  MISC_FEATURE (809)..(809): Xaa is Met or Leu
  MISC_FEATURE (811)..(811): Xaa is Phe or Tyr
  MISC_FEATURE (843)..(843): Xaa is Ala or Glu
  MISC_FEATURE (874)..(874): Xaa is Ser or Ala
  MISC_FEATURE (897)..(897): Xaa is Val or Leu
MATPSMMPQWSYMHIAGQDASEYLSPGLVQFARATDTYFSLGNKFRNPTVAPTHDVTTDRSQRLTLRFVPVDREDTAYSYKVRXTLAVGDNRVLDMASTYFDIRGXLDRGPSFKPYSGTAYNSLAPKGAPNPXXWXXXXXXXKXXXXXQAXXXXXXXXXXXXTXXGXXVXXXXXXXXXXXXYAXKXYQPEPQXGXXXWNXXXXXXXXXAGRXLKXXTPMXPCYGSYAXPTNXXGGQXXXXXXXXXXXXXXXXXXXFFXXXXXXXXXXKXVLYXEXVXXEXPDTHLVFKPXXXXXXXXXXXLLXQQXAPNRPNYIXFRDNFIGLMYYNSTGNMGVLAGQASQLNAVVDLQDRNTELSYQLMLDALGDRSRYFSMWNQAVDSYDPDVRIXENHGVEDELPNYCFPLXGXXXXXXYXXXXXXXXXXXXXXXXXXXXXXXXXXXIXXGNXFAXEINLXANLWRSFLYSNXXLYLPDXXKXTPDNIXLPXNXNXYXYXNGRVTXPXXXDTYVNXGARWSPDXMDXXNPFNHHRNAGLRYRSMLLGNGRYVPFHIQVPQKFFAIKNLLLLPGSYTYEWNFRKDVNMILQSXLGNDLRVDGASXRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLXQMLSHYNIGYQGFYVPENYKDRMYSFFRNFQPMSRQXVDXXXYXXXYXDVKXPXQHNNSGFVGYMGPTMREGQAYPANYPYPLIGXTAVPSLTQKKFLCDRVMWRIPFSSNFMSMGXLTDLGQNMLYANSAHALDMTFEXDPMDEPTLLYVLFEVFDVVRIHQPHRGVIEAVYLRTPFSAGNATT

SEQ ID NO: 272 - protein, 938 aa, Artificial Sequence
  Seq_272 is a consensus majority sequence of SEQ ID NOs: 160-163, 166, and 170
  MISC_FEATURE (84)..(84): Xaa is Tyr or Phe
  MISC_FEATURE (106)..(106): Xaa is Met or Val
  MISC_FEATURE (133)..(133): Xaa is Ser or Ala
  MISC_FEATURE (134)..(134): Xaa is Glu or Gln
  MISC_FEATURE (136)..(136): Xaa is Ile, Glu, Thr, or Asn
  MISC_FEATURE (137)..(137): Xaa is Thr, Gly, or Asn
  MISC_FEATURE (138)..(138): Xaa is Asn, Ser, or Thr
  MISC_FEATURE (139)..(139): Xaa is Gly or absent
  MISC_FEATURE (140)..(140): Xaa is Gly or absent
  MISC_FEATURE (141)..(141): Xaa is Thr or Asp
  MISC_FEATURE (142)..(142): Xaa is Ala, Asn, or Ser
  MISC_FEATURE (144)..(144): Xaa is Thr or Val
  MISC_FEATURE (145)..(145): Xaa is Asn, His, or Lys
  MISC_FEATURE (146)..(146): Xaa is Ser or Val
  MISC_FEATURE (147)..(147): Xaa is Phe or Arg
  MISC_FEATURE (148)..(148): Xaa is Ala or Gly
  MISC_FEATURE (151)..(151): Xaa is Ser or Pro
  MISC_FEATURE (152)..(152): Xaa is Tyr or Phe
  MISC_FEATURE (153)..(153): Xaa is Ile or Val
  MISC_FEATURE (154)..(154): Xaa is Gly or Ser
  MISC_FEATURE (155)..(155): Xaa is Ser or absent
  MISC_FEATURE (156)..(156): Xaa is Tyr or absent
  MISC_FEATURE (157)..(157): Xaa is Met, Gly, or absent
  MISC_FEATURE (158)..(158): Xaa is Gly, Ala, or absent
  MISC_FEATURE (159)..(159): Xaa is Ala, Asp, or Thr
  MISC_FEATURE (160)..(160): Xaa is Asn, Glu, or Ala
  MISC_FEATURE (161)..(161): Xaa is Leu or Ile
  MISC_FEATURE (163)..(163): Xaa is Thr or Lys
  MISC_FEATURE (164)..(164): Xaa is Asn or Glu
  MISC_FEATURE (166)..(166): Xaa is Ile or Val
  MISC_FEATURE (167)..(167): Xaa is Gln or Lys
  MISC_FEATURE (169)..(169): Xaa is Ala or Gly
  MISC_FEATURE (170)..(170): Xaa is Val or Thr
  MISC_FEATURE (171)..(171): Xaa is Asp or Val
  MISC_FEATURE (172)..(172): Xaa is Thr or Leu
  MISC_FEATURE (173)..(173): Xaa is Asn, Gly, or Thr
  MISC_FEATURE (174)..(174): Xaa is Asn or Asp
  MISC_FEATURE (175)..(175): Xaa is Ala, Pro, Ser, or His
  MISC_FEATURE (176)..(176): Xaa is Asn or Gly
  MISC_FEATURE (177)..(177): Xaa is Ser or absent
  MISC_FEATURE (178)..(178): Xaa is Ala or Gln
  MISC_FEATURE (179)..(179): Xaa is Ala or Pro
  MISC_FEATURE (180)..(180): Xaa is Val, Ile, or Gln
  MISC_FEATURE (183)..(183): Xaa is Lys or Asp
  MISC_FEATURE (185)..(185): Xaa is Ile, Ala, Thr, or Glu
  MISC_FEATURE (192)..(192): Xaa is Val or Ile
  MISC_FEATURE (194)..(194): Xaa is Thr or Glu
  MISC_FEATURE (195)..(195): Xaa is Ser, Thr, or Gln
  MISC_FEATURE (196)..(196): Xaa is Arg or Gln
  MISC_FEATURE (199)..(199): Xaa is Ser or absent
  MISC_FEATURE (200)..(200): Xaa is Asp or absent
  MISC_FEATURE (201)..(201): Xaa is Ile or Val
  MISC_FEATURE (202)..(202): Xaa is Asn or Gly
  MISC_FEATURE (203)..(203): Xaa is Pro, Thr, or Ala
  MISC_FEATURE (204)..(204): Xaa is Thr or Asn
  MISC_FEATURE (205)..(205): Xaa is Gln or Asp
  MISC_FEATURE (206)..(206): Xaa is Asn or Lys
  MISC_FEATURE (207)..(207): Xaa is Ile or Ala
  MISC_FEATURE (211)..(211): Xaa is Ile or Val
  MISC_FEATURE (214)..(214): Xaa is Pro or Lys
  MISC_FEATURE (219)..(219): Xaa is Gln, Val, or Phe
  MISC_FEATURE (227)..(227): Xaa is Tyr or Lys
  MISC_FEATURE (232)..(232): Xaa is Asn, Glu, or Lys
  MISC_FEATURE (236)..(236): Xaa is Val or Ala
  MISC_FEATURE (237)..(237): Xaa is Lys or Thr
  MISC_FEATURE (238)..(238): Xaa is Ile, Asn, or Pro
  MISC_FEATURE (239)..(239): Xaa is Thr, Ser, or absent
  MISC_FEATURE (240)..(240): Xaa is Ala, Asp, or absent
  MISC_FEATURE (241)..(241): Xaa is Gly or absent
  MISC_FEATURE (242)..(242): Xaa is Ser or absent
  MISC_FEATURE (243)..(243): Xaa is Thr or absent
  MISC_FEATURE (244)..(244): Xaa is Asp or absent
  MISC_FEATURE (245)..(245): Xaa is Pro, Ser, or absent
  MISC_FEATURE (246)..(246): Xaa is Thr, Gln, or absent
  MISC_FEATURE (247)..(247): Xaa is Gly, Asp, or absent
  MISC_FEATURE (248)..(248): Xaa is Ala, Val, or absent
  MISC_FEATURE (249)..(249): Xaa is Asn or Gln
  MISC_FEATURE (250)..(250): Xaa is Ser, Gln, or Asn
  MISC_FEATURE (251)..(251): Xaa is Val or Pro
  MISC_FEATURE (252)..(252): Xaa is Asp, Ser, or Glu
  MISC_FEATURE (253)..(253): Xaa is Met or Leu
  MISC_FEATURE (254)..(254): Xaa is Glu or Gln
  MISC_FEATURE (257)..(257): Xaa is Thr, Ser, or Ala
  MISC_FEATURE (258)..(258): Xaa is Thr or Ser
  MISC_FEATURE (259)..(259): Xaa is Thr or Gly
  MISC_FEATURE (260)..(260): Xaa is Ala, Ser, or Asn
  MISC_FEATURE (261)..(261): Xaa is Asp, Ser, or Val
  MISC_FEATURE (262)..(262): Xaa is Asn or Ala
  MISC_FEATURE (263)..(263): Xaa is Gln or absent
  MISC_FEATURE (264)..(264): Xaa is Asn or Thr
  MISC_FEATURE (265)..(265): Xaa is Gln or Thr
  MISC_FEATURE (266)..(266): Xaa is Ala or Pro
  MISC_FEATURE (268)..(268): Xaa is Val or Ala
  MISC_FEATURE (272)..(272): Xaa is Ser or Ala
  MISC_FEATURE (276)..(276): Xaa is Asn, Ser, Ala, or Thr
  MISC_FEATURE (277)..(277): Xaa is Leu or Ile
  MISC_FEATURE (279)..(279): Xaa is Ala or Thr
  MISC_FEATURE (289)..(289): Xaa is Asp, Thr, or Ile
  MISC_FEATURE (291)..(291): Xaa is Ala or Thr
  MISC_FEATURE (292)..(292): Xaa is Asp, Ala, or Glu
  MISC_FEATURE (293)..(293): Xaa is Asn or Gly
  MISC_FEATURE (294)..(294): Xaa is Ala, Val, Ile, or Thr
  MISC_FEATURE (295)..(295): Xaa is Lys or Thr
  MISC_FEATURE (296)..(296): Xaa is Ala, Asn, or Ser
  MISC_FEATURE (297)..(297): Xaa is Ala or Ser
  MISC_FEATURE (299)..(299): Xaa is Thr or Ala
  MISC_FEATURE (302)..(302): Xaa is Gly, Ala, or Thr
  MISC_FEATURE (305)..(305): Xaa is Ser or Ala
  MISC_FEATURE (314)..(314): Xaa is Gly or Ala
  MISC_FEATURE (387)..(387): Xaa is Ile or Val
  MISC_FEATURE (404)..(404): Xaa is Asn or Gly
  MISC_FEATURE (406)..(406): Xaa is Gln or Met
  MISC_FEATURE (407)..(407): Xaa is Gly or Ala
  MISC_FEATURE (408)..(408): Xaa is Ile or Val
  MISC_FEATURE (409)..(409): Xaa is Ser or Thr
  MISC_FEATURE (410)..(410): Xaa is Asn or Asp
  MISC_FEATURE (413)..(413): Xaa is Arg or Ser
  MISC_FEATURE (414)..(414): Xaa is Gly or Pro
  MISC_FEATURE (415)..(415): Xaa is Leu or Ile
  MISC_FEATURE (416)..(416): Xaa is Ser or Lys
  MISC_FEATURE (417)..(417): Xaa is Val or Pro
  MISC_FEATURE (418)..(418): Xaa is Gln, Ser, Asn, or Asp
  MISC_FEATURE (419)..(419): Xaa is Asn, Asp, or Thr
  MISC_FEATURE (420)..(420): Xaa is Gly, Asn, or Ala
  MISC_FEATURE (421)..(421): Xaa is Gln or Gly
  MISC_FEATURE (422)..(422): Xaa is Asn, Gly, or Thr
  MISC_FEATURE (423)..(423): Xaa is Thr or Gly
  MISC_FEATURE (424)..(424): Xaa is Trp or Phe
  MISC_FEATURE (425)..(425): Xaa is Gln, Glu, or Ser
  MISC_FEATURE (426)..(426): Xaa is Ala or Asn
  MISC_FEATURE (427)..(427): Xaa is Asn or Asp
  MISC_FEATURE (428)..(428): Xaa is Asn or absent
  MISC_FEATURE (429)..(429): Xaa is Asn or Asp
  MISC_FEATURE (430)..(430): Xaa is Ala, Thr, or Val
  MISC_FEATURE (431)..(431): Xaa is Ala, Val, or Phe
  MISC_FEATURE (432)..(432): Xaa is Glu, Ala, or Thr
  MISC_FEATURE (433)..(433): Xaa is Asp, Thr, or Asn
  MISC_FEATURE (434)..(434): Xaa is Arg or Asn
  MISC_FEATURE (435)..(435): Xaa is Gly or absent
  MISC_FEATURE (436)..(436): Xaa is Val, Ile, or absent
  MISC_FEATURE (439)..(439): Xaa is Gly or Ser
  MISC_FEATURE (440)..(440): Xaa is Ser or Ile
  MISC_FEATURE (443)..(443): Xaa is Ile or Met
  MISC_FEATURE (451)..(451): Xaa is Ala or Gln
  MISC_FEATURE (457)..(457): Xaa is Ser or Gly
  MISC_FEATURE (463)..(463): Xaa is Val or Ile
  MISC_FEATURE (464)..(464): Xaa is Ala or Gly
  MISC_FEATURE (470)..(470): Xaa is Ser or Thr
  MISC_FEATURE (471)..(471): Xaa is Tyr or Leu
  MISC_FEATURE (473)..(473): Xaa is Tyr, Leu, or Ile
  MISC_FEATURE (479)..(479): Xaa is Glu or Thr
  MISC_FEATURE (482)..(482): Xaa is Glu, Asp, or Thr
  MISC_FEATURE (484)..(484): Xaa is Gln or Lys
  MISC_FEATURE (486)..(486): Xaa is Ser or Thr
  MISC_FEATURE (488)..(488): Xaa is Gly or Gln
  MISC_FEATURE (490)..(490): Xaa is Ile or Met
  MISC_FEATURE (496)..(496): Xaa is Ala or Pro
  MISC_FEATURE (498)..(498): Xaa is Asn or Gly
  MISC_FEATURE (499)..(499): Xaa is Ala or Leu
  MISC_FEATURE (500)..(500): Xaa is Ile or Val
  MISC_FEATURE (506)..(506): Xaa is Ile or Val
  MISC_FEATURE (514)..(514): Xaa is Pro or Val
  MISC_FEATURE (517)..(517): Xaa is Asn, Ser, or Gly
  MISC_FEATURE (518)..(518): Xaa is Val or Ile
  MISC_FEATURE (582)..(582): Xaa is Thr or Ser
  MISC_FEATURE (594)..(594): Xaa is Val or Ile
  MISC_FEATURE (791)..(791): Xaa is Val or Ile
  MISC_FEATURE (794)..(794): Xaa is Ser or Thr
  MISC_FEATURE (795)..(795): Xaa is Val or Thr
  MISC_FEATURE (796)..(796): Xaa is Asn, Ala, Ser, or Thr
  MISC_FEATURE (798)..(798): Xaa is Ala or Thr
  MISC_FEATURE (799)..(799): Xaa is Asp or Asn
  MISC_FEATURE (801)..(801): Xaa is Lys or Gln
  MISC_FEATURE (802)..(802): Xaa is Glu or Asp
  MISC_FEATURE (805)..(805): Xaa is Met or Leu
  MISC_FEATURE (807)..(807): Xaa is Phe or Tyr
  MISC_FEATURE (839)..(839): Xaa is Glu or Ala
  MISC_FEATURE (870)..(870): Xaa is Ser or Ala
  MISC_FEATURE (893)..(893): Xaa is Val or Leu
MATPSMMPQWSYMHIAGQDASEYLSPGLVQFARATDTYFSLGNKFRNPTVAPTHDVTTDRSQRLTLRFVPVDREDTAYSYKVRXTLAVGDNRVLDMASTYFDIRGXLDRGPSFKPYSGTAYNSLAPKGAPNPXXWXXXXXXXKXXXXXQAXXXXXXXXXXXTXXGXXVXXXXXXXXXXXXYAXKXYQPEPQXGXXXWNXXXXXXXXXAGRXLKXTTPMXPCYGSYAXPTNEXGGQXXXXXXXXXXXXXXXXXXXFFXXXXXXXXXXKXVLYXEDVXXEXPDTHLVFKPXVXXXXXXXEXLLXQQXAPNRPNYIXFRDNFIGLMYYNSTGNMGVLAGQASQLNAVVDLQDRNTELSYQLMLDALGDRSRYFSMWNQAVDSYDPDVRIXENHGVEDELPNYCFPLXGXXXXXTYXXXXXXXXXXXXXXXXXXXXXXXXEIXXGNXFAMEINLXANLWRXFLYSNXXLYLPDXXKXTPDNIXLPXNXNXYXYXNGRVTXPXXXDTYVNXGARWSPDXMDXXNPFNHHRNAGLRYRSMLLGNGRYVPFHIQVPQKFFAIKNLLLLPGSYTYEWNFRKDVNMILQSXLGNDLRVDGASXRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQXVDXXXYXXYXXVKXPXQHNNSGFVGYMGPTMREGQAYPANYPYPLIGXTAVPSLTQKKFLCDRVMWRIPFSSNFMSMGXLTDLGQNMLYANSAHALDMTFEXDPMDEPTLLYVLFEVFDVVRIHQPHRGVIEAVYLRTPFSAGNATT

The invention claimed is:

1. A recombinant adenovirus comprising:
   (I) a nucleotide sequence encoding a hexon protein, wherein:
      (a) the nucleotide sequence encoding the hexon protein has at least 93% sequence identity over the entire sequence of SEQ ID NO: 56; or
      (b) the hexon protein comprises 99% or greater sequence identity over the entire amino acid sequence of SEQ ID NO: 160;
   (II) a nucleotide sequence encoding a short fiber protein, a long fiber protein, and/or a penton protein, wherein:
      (a) the nucleotide sequence encoding the short fiber protein has at least 85% identity to the nucleotide sequence of SEQ ID NO: 19;
      (b) the short fiber protein has at least 85% identity to the amino acid sequence of SEQ ID NO: 123;
      (c) the nucleotide sequence encoding the long fiber protein has at least 90% identity to the nucleotide sequence of SEQ ID NO: 42;
      (d) the long fiber protein has at least 90% identity to the amino acid sequence of SEQ ID NO: 146;
      (e) the nucleotide sequence encoding the penton protein has at least 95% sequence identity over the entire sequence of SEQ ID NO: 108, and/or
      (f) the penton protein comprises 96% or greater sequence identity over the entire amino acid sequence of SEQ ID NO: 212; and
   (III) a deletion in or of the E1, E2, and/or E3 region.

2. The recombinant adenovirus of claim 1, wherein:
   (I) the nucleotide sequence encoding the hexon protein of (I)(a) has:
      (a) at least 94%, 95%, 96%, 97%, 98%, 99%, and 100% sequence identity over the entire sequence of SEQ ID NO: 56; or
   (II) the nucleotide sequence encoding the hexon protein of (I)(b) has 100% sequence identity over the entire sequence of SEQ ID NO: 160.

3. The recombinant adenovirus of claim 1, wherein:
   (I) the nucleotide sequence encoding the short fiber protein has at least 90%, 92%, 95%, 97%, 99%, or 100% sequence identity to all or a part of the nucleic acid sequence of SEQ ID NO: 19;
   (II) the nucleotide sequence encoding the long fiber protein has at least 91%, 92%, 95%, 97%, 98%, 99%, or 100% sequence identity to all or a part of the nucleic acid sequence of SEQ ID NO: 42; and/or
   (III) the nucleotide sequence encoding the penton protein has at least 97%, 99%, or 100% sequence identity to all or a part of the nucleic acid sequence of SEQ ID NO: 108.

4. The recombinant adenovirus of claim 1, wherein:
   (I) the short fiber protein has at least 90%, 92%, 95%, 97%, 98%, 99%, or 100% sequence identity to all or a part of the amino acid sequence of SEQ ID NO: 123;
   (II) the long fiber protein has at least 91%, 92%, 95%, 97%, 98%, 99%, or 100% sequence identity to all or a part of the amino acid sequence of SEQ ID NO: 146; and/or
   (III) the penton protein has at least 97%, 98%, 99%, or 100% sequence identity to all or a part of the amino acid sequence of SEQ ID NO: 212.

5. The recombinant adenovirus of claim 1, wherein the recombinant adenovirus is a replication-defective virus, binds a sialic acid receptor, and/or further comprises a heterologous nucleotide sequence encoding an antigenic or therapeutic gene product or fragment thereof.

6. The recombinant adenovirus of claim 5, wherein the recombinant adenovirus further comprises the antigenic gene product or fragment thereof, wherein the antigenic gene product or fragment thereof comprises a bacterial protein or fragment thereof; a viral protein or fragment thereof; a parasitic protein or fragment thereof; or a fungal protein or fragment thereof.

7. The recombinant adenovirus of claim 6, wherein:
   (I) the bacterial protein or fragment thereof, is from *Mycobacterium tuberculosis, Mycobacterium bovis, Mycobacterium africanum, Mycobacterium microti, Mycobacterium leprae, Pseudomonas aeruginosa, Salmonella typhimurium, Escherichia coli, Klebsiella pneumoniae, Streptococcus pneumoniae, Staphylococcus aureus, Francisella tularensis, Brucella, Burkholderia mallei, Yersinia pestis, Corynebacterium diphtheria, Neisseria meningitidis, Bordetella pertussis, Clostridium tetani,* or *Bacillus anthracis;*
   (II) the viral protein or fragment thereof, is:
      (a) from a viral family selected from the group consisting of Retroviridae, Flaviviridae, Arenaviridae, Bunyaviridae, Filoviridae, Togaviridae, Poxviridae, Herpesviridae, Orthomyxoviridae, Coronaviridae, Rhabdoviridae, Paramyxoviridae, Picornaviridae, Hepadnaviridae, Papillomaviridae, Parvoviridae, Astroviridae, Polyomaviridae, Calciviridae, and Reoviridae;
      (b) from human immunodeficiency virus (HIV), human papillomavirus (HPV), hepatitis A virus (Hep A), hepatitis B virus (HBV), hepatitis C virus (HCV), *Variola major, Variola minor,* monkeypox virus, measles virus, rubella virus, mumps virus, varicella zoster virus (VZV), poliovirus, rabies virus, Japanese encephalitis virus, herpes simplex virus (HSV), cytomegalovirus (CMV), rotavirus, influenza, Ebola virus, yellow fever virus, Zika virus, or Marburg virus; and/or
      (c) an envelope glycoprotein or fragment thereof;
   (III) the parasitic protein or fragment thereof, is from *Toxoplasma gondii, Plasmodium falciparum, Plasmodium vivax, Plasmodium ovale, Plasmodium malariae, Trypanosoma* spp., or *Legionella* spp.; or
   (IV) the fungal protein or fragment thereof, is from *Aspergillus, Blastomyces dermatitidis, Candida, Coccidioides immitis, Cryptococcus neoformans, Histoplasma capsulatum* var. *capsulatum, Paracoccidioides brasiliensis, Sporothrix schenckii, Zygomycetes* spp., *Absidia corymbifera, Rhizomucor pusillus,* or *Rhizopus arrhizus.*

8. The recombinant adenovirus of claim 7, wherein the viral protein or fragment thereof, from HIV is Gag, Pol, Env, Nef, Tat, Rev, Vif, Vpr, or Vpu.

9. A method of inducing an immune response or treating a disease in a subject, the method comprising administering the recombinant adenovirus of claim 1 to the subject.

10. The method of claim 9, wherein the recombinant adenovirus comprises an antigenic gene product or fragment thereof, that promotes an immune response in the subject against an infective agent.

11. The method of claim 10, wherein:
   (I) the immune response comprises a decrease in expression of interleukin-9 (IL9) relative to a reference level;
   (II) the antigenic gene product or fragment thereof, comprises a bacterial protein or fragment thereof, a viral protein or fragment thereof, a parasitic protein or fragment thereof, or a fungal protein or fragment thereof; or
   (III) the infective agent is a bacterium, a virus, a parasite, or a fungus.

12. The method of claim 11, wherein:
   (I) the bacterial protein or fragment thereof is from *Mycobacterium tuberculosis, Mycobacterium bovis, Mycobacterium africanum, Mycobacterium microti, Mycobacterium leprae, Pseudomonas aeruginosa, Salmonella typhimurium, Escherichia coli, Klebsiella pneumoniae, Streptococcus pneumoniae, Staphylococcus aureus, Francisella tularensis, Brucella, Burkholderia mallei, Yersinia pestis, Corynebacterium diphtheria, Neisseria meningitidis, Bordetella pertussis, Clostridium tetani,* or *Bacillus anthracis;*
   (II) the viral protein or fragment thereof is:
      (a) from a viral family selected from the group consisting of Retroviridae, Flaviviridae, Arenaviridae, Bunyaviridae, Filoviridae, Togaviridae, Poxviridae, Herpesviridae, Orthomyxoviridae, Coronaviridae, Rhabdoviridae, Paramyxoviridae, Picornaviridae, Hepadnaviridae, Papillomaviridae, Parvoviridae, Astroviridae, Polyomaviridae, Calciviridae, and Reoviridae;
      (b) from human immunodeficiency virus (HIV), human papillomavirus (HPV), hepatitis A virus (Hep A), hepatitis B virus (HBV), hepatitis C virus (HCV), *Variola major, Variola minor,* monkeypox virus, measles virus, rubella virus, mumps virus, varicella zoster virus (VZV), poliovirus, rabies virus, Japanese encephalitis virus, herpes simplex virus (HSV), cytomegalovirus (CMV), rotavirus, influenza, Ebola virus, yellow fever virus, Zika virus, or Marburg virus; or
      (c) an envelope glycoprotein or fragment thereof;
   (III) the parasitic protein or fragment thereof is from *Toxoplasma gondii, Plasmodium falciparum, Plasmodium vivax, Plasmodium ovale, Plasmodium malariae, Trypanosoma* spp., or *Legionella* spp.; or
   (IV) the fungal protein or fragment thereof is from *Aspergillus, Blastomyces dermatitidis, Candida, Coccidioides immitis, Cryptococcus neoformans, Histoplasma capsulatum* var. *capsulatum, Paracoccidioides brasiliensis, Sporothrix schenckii, Zygomycetes* spp., *Absidia corymbifera, Rhizomucor pusillus,* or *Rhizopus arrhizus.*

13. The method of claim 12, wherein the viral protein or fragment thereof from HIV is Gag, Pol, Env, Nef, Tat, Rev, Vif, Vpr, or Vpu.

14. The method of claim 9, wherein the disease is acquired immune deficiency syndrome (AIDS), cancer, tuberculosis, leprosy, typhoid fever, pneumonia, meningitis, staphylococcal scalded skin syndrome (SSSS), Ritter's disease, tularemia (rabbit fever), brucellosis, Glanders disease, bubonic plague, septicemic plague, pneumonic plague, diphtheria, pertussis (whooping cough), tetanus, anthrax, hepatitis, smallpox, monkeypox, measles, mumps, rubella, chicken pox, polio, rabies, Japanese encephalitis, herpes, mononucleosis, influenza, Ebola virus disease, hemorrhagic fever, yellow fever, Zika fever, Marburg virus disease, toxoplasmosis, malaria, trypanosomiasis, legionellosis, aspergillosis, blastomycosis, candidiasis (thrush), coccidioidomycosis, cryptococcosis, histoplasmosis, paracoccidioidomycosis, sporotrichosis, or sinus-orbital zygomycosis.

15. The method of claim 9, wherein the recombinant adenovirus is administered intramuscularly, intravenously, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctivally, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in cremes, or in lipid compositions; and/or wherein the recombinant adenovirus, is administered as a pharmaceutical composition comprising a pharmaceutically acceptable carrier.

16. The method of claim 15, wherein the subject is administered at least one or two doses of the pharmaceutical composition.

17. The method of claim 16, wherein the pharmaceutical composition is administered to the subject as part of a prime-boost regimen, comprising a priming step followed by a boosting step.

18. The method of claim 17, wherein the prime-boost regimen is:
   (I) a homologous prime-boost regimen, wherein the priming step and the boosting step comprises administration of the pharmaceutical composition; or
   (II) a heterologous prime-boost regimen, wherein:
      (a) the priming step comprises administration of the pharmaceutical composition; or
      (b) the boosting step comprises administration of the pharmaceutical composition.

19. The method of claim 18, wherein the boosting step of the heterologous prime-boost regimen in part (II)(a) or the priming step of the heterologous prime-boost regimen in part (II)(b) comprises administration of a second, different pharmaceutical composition.

20. The method of claim 19, wherein the second pharmaceutical composition comprises a recombinant adenovirus, a recombinant vector, a polynucleotide, or a polypeptide.

21. The method of claim 19, wherein the second pharmaceutical composition comprises a rhesus adenoviral (RhAd) vector or a human adenoviral (HuAd) vector.

22. The method of claim 21, wherein:
   (I) the RhAd vector is a RhAd51 vector, a RhAd52 vector, or a RhAd53 vector; or
   (II) the HuAd vector is a HuAd5 vector.

23. A method of producing a recombinant adenovirus comprising transfecting a cell with the recombinant adenovirus of claim 1; culturing the cell in a suitable medium to allow replication of the recombinant adenovirus in said cell; and harvesting the recombinant adenovirus from the cell and/or from the medium.

24. The method of claim 23, wherein the cell is a mammalian cell.

25. The method of claim 24, wherein the mammalian cell is a Chinese hamster ovary (CHO) cell.

26. The recombinant adenovirus of claim 1, wherein:
   (I) the nucleotide sequence encoding the hexon protein of (I)(a) has at least 90%, 92%, 95%, 97%, 98%, 99%, or 100% sequence identity to:
      (a) all or a part of the nucleic acid sequence of SEQ ID NO: 3; and/or
      (b) all or a part of the nucleic acid sequence of any one of SEQ ID NOs: 228-233; or
   (II) the nucleotide sequence encoding the hexon protein of (I)(b) has:
      (a) at least 98% or 100% sequence identity over the entire nucleic acid sequence of SEQ ID NO: 3; and/or
      (b) at least 90%, 92%, 95%, 97%, 98%, 99%, or 100% sequence identity to all or a part of the nucleic acid sequence of any one of SEQ ID NOs: 228-233.

* * * * *

UNITED STATES PATENT AND TRADEMARK OFFICE
CERTIFICATE OF CORRECTION

PATENT NO. : 11,773,142 B2
APPLICATION NO. : 16/772045
DATED : October 3, 2023
INVENTOR(S) : Dan H. Barouch et al.

It is certified that error appears in the above-identified patent and that said Letters Patent is hereby corrected as shown below:

In the Claims

Column 144, Claim 4, Line 55-56, replace "146; and/or" with --146;--.

Column 147, Claim 15, Line 5, replace "adenovirus, is" with --adenovirus is--.

Signed and Sealed this
Twenty-seventh Day of February, 2024

Katherine Kelly Vidal
*Director of the United States Patent and Trademark Office*